US012474355B2

(12) United States Patent
Weiner et al.

(10) Patent No.: US 12,474,355 B2
(45) Date of Patent: Nov. 18, 2025

(54) COMBINATIONS OF BIOMARKERS FOR METHODS FOR DETECTING TRISOMY 21

(71) Applicants: Carl Philip Weiner, Mission Hills, KS (US); Yafeng Dong, Overland Park, KS (US)

(72) Inventors: Carl Philip Weiner, Mission Hills, KS (US); Yafeng Dong, Overland Park, KS (US)

(73) Assignee: ROSETTA SIGNALING LABORATORIES, LLC

( * ) Notice: Subject to any disclaimer, the term of this patent is extended or adjusted under 35 U.S.C. 154(b) by 1092 days.

(21) Appl. No.: 17/203,534

(22) Filed: Mar. 16, 2021

(65) Prior Publication Data

US 2021/0199673 A1 Jul. 1, 2021

Related U.S. Application Data

(63) Continuation-in-part of application No. 14/361,895, filed as application No. PCT/US2012/067328 on Nov. 30, 2012, now abandoned.

(60) Provisional application No. 61/565,761, filed on Dec. 1, 2011.

(51) Int. Cl.
*G01N 33/53* (2006.01)
*G01N 33/68* (2006.01)

(52) U.S. Cl.
CPC ..... *G01N 33/6896* (2013.01); *G01N 33/5308* (2013.01); *G01N 2800/387* (2013.01)

(58) Field of Classification Search
CPC ........... G01N 33/6896; G01N 33/5308; G01N 2800/387; C12Q 2600/156; C12Q 2600/158
See application file for complete search history.

(56) References Cited

U.S. PATENT DOCUMENTS

2002/0045176 A1 4/2002 Lo et al.
2006/0252068 A1* 11/2006 Lo ........................ C12Q 1/6883 435/6.17
2008/0138809 A1* 6/2008 Kapur ...................... G01N 1/30 435/6.12
2010/0173288 A1 7/2010 Zhang et al.
2012/0283125 A1 11/2012 Sinard et al.
2013/0217028 A1 8/2013 Mandel et al.

FOREIGN PATENT DOCUMENTS

CN 110499364 A 7/2019
WO 2005021793 A1 3/2005
WO 2005078094 A1 8/2005
WO WO-2013082448 A1 * 6/2013 ........... C12Q 1/6883

OTHER PUBLICATIONS

Shi et al. ("Integrated miRNA and mRNA expression profiling in fetal hippocampus with Down syndrome." Journal of biomedical science 23.1 (2016): 1-12.). (Year: 2016).*
Tani et al.; "Circulating cell-free mRNA in plasma as a tumor marker for patients with primary and recurrent gastric cancer"; Anticancer Research; Mar.-Apr. 2007; vol. 27(2): pp. 1207-1212; PMID: 17465264.
Barrachina et al.; "TaqMan PCR assay in the control of RNA normalization in human post-mortem brain tissue"; Neurochemisry International; Aug. 2006;49(3):276-84. DOI: 10.1016/j.neuint.2006.01.018; E-pub: Mar. 7, 2006. PMID: 16522342.
Affymetrix "GeneChip® Human Genome U133A Array Probe List", as obtained from NCBI GEO, 2002, https://www.ncbi.nlm.nih.gov/geo/query/acc/cgi?acc=GPL96.
Affymetrix "GeneChip® Exon Array Design Technical Note"; 2005; downloaded from http://media.affymetrix.com/support/technical/technotes/exon_array_design/technote.pdf.
European Patent Office; International Search Report and Written Opinion issued in Application No. PCT/US2012/067328 on Feb. 5, 2013; 18 pages.
Affymetrix "GeneChip® Exon Array System for Human, Mouse and Rat"; Jan. 1, 2006; XP002480421; Retrieved from the internet: http://www.affymetrix.com/products/arrays/exon_application.affx.
Elena Picchiassi et al.; "Identification of Universal mRNA Markers for Noninvasive Prenatal Screening of Trisomies"; Prenatal Diagnosis; vol. 30, No. 8; pp. 764-770, Jun. 20, 2010; XP055051550, ISSN: 0-197-3851, DOI: 10.1002/pd 2541.
N.B.Y. Tsui et al.; "Synergy of Total PLAC4 RNA Concentration and Measurement of the RNA Single-Nucleotide Polymorphism Allelic Ratio for the Noninvasive Prenatal Detection of Trisomy 21"; Clinical Chemistry vol. 56, No. 1; pp. 73-81, Jan. 1, 2010; XP055050064; ISSN: 0009-9147, DOI: 10.1373/clinchem.2009.132662.
Attie Go et al.; "Non-invasive aneuploidy detection using free fetal DNA and RNA in Maternal Plasma: Recent Progress and Future Possibilities", Human Reproduction Update, vol. 17, No., 3, pp. 372-382, Nov. 12, 2010; XP055052831, ISSN: 1355-4786, DOI: 10.1093/humupd/dmq054.
Attie Go et al.; "A Novel Method to Identify Syncytiotrophoblast-derived RNA products representative of trisomy 21 placental RNA in maternal plasma", Methods of Molecular Biology, Human Press Inc, NJ, US; vol. 444, pp. 291-302, Jan. 1, 2008; XP009132506, ISSN: 1064-3745.

(Continued)

*Primary Examiner* — Sahana S Kaup
(74) *Attorney, Agent, or Firm* — MASCHOFF BRENNAN

(57) ABSTRACT

Methods for detecting a Group of Biomarkers is provided herein. The translation profile of the Group of Biomarkers can be used for determining whether a subject, such as a fetus, has Down syndrome The methods include detecting one or more specific groups of biomarkers in a biological sample, and determining whether the expression of the biomarkers is altered when compared to expression of the biomarkers in one or more subjects that do not have trisomy 21 (e.g., a transcriptional standard). The biological sample can be a blood sample, and the biomarkers are cell free plasma RNAs.

12 Claims, 423 Drawing Sheets

Specification includes a Sequence Listing.

(56) References Cited

OTHER PUBLICATIONS

Sjakste N. et al.; "Nuclear Matrix Proteins and Hereditary Diseases", Russian Journal of Genetics, Nauka/Interperiodica, MO, vol. 41, No. 3, pp. 221-226, Mar. 1, 2005, XP019301467, ISSN: 1608-3369.

United States Patent and Trademark Office; International Search Report and Written Opinion issued in Int'l. App. No. PCT/US2022/019680 dated Jul. 27, 2022, 42 pages.

Weiner, Carl Phillip et al.; "Evaluation of a Maternal Plasma RNA Panel Predicting Spontaneous Preterm Birth and Its Expansion to the Prediction of Preeclampsia"; whitepaper; MDPI; published May 27, 2022; 16 pages; https://doi.org/10.3390/diagnostics12061327.

Weiner, Carl Phillip et al.; "Detection of Embryonic Trisomy 21 in the First Trimester Using Maternal Plasma Cell-Free RNA"; whitepaper; MDPI; published Jun. 7, 2022; 23 pages; https://doi.org/10/3390/diagnostics12061410.

* cited by examiner

Figure 1.

SEQ ID NO:1
GAACGTGGTATAAAAGGGGCGGGAGGCCAGGCTCGTGCCGTTTTGCAGACGCCACCGCCGAGGAAAACCG
TGTACTATTAGCCATGGTCAACCCCACCGTGTTCTTCGACATTGCCGTCGACGGCGAGCCCTTGGGCCGC
GTCTCCTTTGAGCTGTTTGCAGACAAGGTCCCAAAGACAGCAGAAAATTTTCGTGCTCTGAGCACTGGAG
AGAAAGGATTTGGTTATAAGGGTTCCTGCTTTCACAGAATTATTCCAGGGTTTATGTGTCAGGGTGGTGA
CTTCACACGCCATAATGGCACTGGTGGCAAGTCCATCTATGGGGAGAAATTTGAAGATGAGAACTTCATC
CTAAAGCATACGGGTCCTGGCATCTTGTCCATGGCAAATGCTGGACCCAACACAAATGGTTCCCAGTTTT
TCATCTGCACTGCCAAGACTGAGTGGTTGGATGGCAAGCATGTGGTGTTTGGCAAAGTGAAAGAAGGCAT
GAATATTGTGGAGGCCATGGAGCGCTTTGGGTCCAGGAATGGCAAGACCAGCAAGAAGATCACCATTGCT
GACTGTGGACAACTCGAATAAGTTTGACTTGTGTTTTATCTTAACCACCAGATCATTCCTTCTGTAGCTC
AGGAGAGCACCCCTCCACCCCATTTGCTCGCAGTATCCTAGAATCTTTGTGCTCTCGCTGCAGTTCCCTT
TGGGTTCCATGTTTTCCTTGTTCCCTCCCATGCCTAGCTGGATTGCAGAGTTAAGTTTATGATTATGAAA
TAAAAACTAAATAACAATTGTCCTCGTTTGAGTTAAGAGTGTTGATGTAGGCTTTATTTTAAGCAGTAAT
GGGTTACTTCTGAAACATCACTTGTTTGCTTAATTCTACACAGTACTTAGATTTTTTTTACTTTCCAGTC
CCAGGAAGTGTCAATGTTTGTTGAGTGGAATATTGAAAATGTAGGCAGCAACTGGGCATGGTGGCTCACT
GTCTGTAATGTATTACCTGAGGCAGAAGACCACCTGAGGGTAGGAGTCAAGATCAGCCTGGGCAACATAG
TGAGACGCTGTCTCTACAAAAAATAATTAGCCTGGCCTGGTGGTGCATGCCTAGTCCTAGCTGATCTGGA
GGCTGACGTGGGAGGATTGCTTGAGCCTAGAGTGAGCTATTATCATGCCACTGTACAGCCTGGGTGTTCA
CAGATCTTGTGTCTCAAAGGTAGGCAGAGGCAGGAAAAGCAAGGAGCCAGAATTAAGAGGTTGGGTCAGT
CTGCAGTGAGTTCATGCATTTAGAGGTGTTCTTCAAGATGACTAATGTCAAAAATTGAGACATCTGTTGC
GGTTTTTTTTTTTTTTTTTTCCCCTGGAATGCAGTGGCGTGATCTCAGCTCACTGCAGCCTCCGCCTCCT
GGGTTCAAGTGATTCTAGTGCCTCAGCCTCCTGAGTAGCTGGGATAATGGGCGTGTGCCACCATGCCCAG
CTAATTTTTGTATTTTTAGTATAGATGGGGTTTCATCATTTTGACCAGGCTGGTCTCAAACTCTTGACCT
CAGCTGATGCGCCTGCCTTGGCCTCCCAAACTGCTGAGATTACAGATGTGAGCCACCGCACCCTACCTCA
TTTTCTGTAACAAAGCTAAGCTTGAACACTGTTGATGTTCTTGAGGGAAGCATATTGGGCTTTAGGCTGT
AGGTCAAGTTTATACATCTTAATTATGGTGGAATTCCTATGTAGAGTCTAAAAAGCCAGGTACTTGGTGC
TACAGTCAGTCTCCCTGCAGAGGGTTAAGGCGCAGACTACCTGCAGTGAGGAGGTACTGCTTGTAGCATA
TAGAGCCTCTCCCTAGCTTTGGTTATGGAGGCTTTGAGGTTTTGCAAACCTGACCAATTTAAGCCATAAG
ATCTGGTCAAAGGGATACCCTTCCCACTAAGGACTTGGTTTCTCAGGAAATTATATGTACAGTGCTTGCT
GGCAGTTAGATGTCAGGACAATCTAAGCTGAGAAAACCCCTTCTCTGCCCACCTTAACAGACCTCTAGGG
TTCTTAACCCAGCAATCAAGTTTGCCTATCCTAGAGGTGGCGGATTTGATCATTTGGTGTGTTGGGCAAT
TTTTGTTTTACTGTCTGGTTCCTTCTGCGTGAATTACCACCACCACCACTTGTGCATCTCAGTCTTGTGT
GTTGTCTGGTTACGTATTCCCTGGGTGATACCATTCAATGTCTTAATGTACTTGTGGCTCAGACCTGAGT
GCAAGGTGGAAATAAACATCAAACATCTTTTCATTA

SEQ ID NO:2
GTTCTTGCTTCGGCAGAACATATACTAAAATTGGAACGATACAGAGAAGATTAGCATGGCCCCTGCGCAA
GGATGACACGCAAAATCGTGAAGCGTTCCACATTTTT

SEQ ID NO:3
GTTCTTGCTTCGGCAGAACATATACTAAAATTGGAACGATACAGAGAAGATTAGCATGGCCCCTGCGCAA
GGATGACACGCAAAATCGTGAAGCGTTCCACATTTTT

SEQ ID NO:4
GTTCTTGCTTCGGCAGAACATATACTAAAATTGGAACGATACAGAGAAGATTAGCATGGCCCCTGCGCAA
GGATGACACGCAAAATCGTGAAGCGTTCCACATTTTT

Fig. 2A-1

Comprehensive Description of mRNA T21 Biomarkers

| Biomarker ID | Chromosome location | Gene Symbol | RefSeq | Fold-Change |
|---|---|---|---|---|
| 8 | chr1 | LMNA | NM_170707 | Down |
| 9 | chr1 | PLEKHN1 | NM_032129 | Down |
| 10 | chr1 | B3GALT6 | NM_080605 | Down |
| 11 | chr1 | ACAP3 | NM_030649 | Down |
| 12 | chr1 | CPSF3L | NM_017871 | up |
| 13 | chr1 | --- | --- | Down |
| 14 | chr1 | FLJ14100 | AK024162 | Down |
| 15 | chr1 | MORN1 | NM_024848 | up |
| 16 | chr1 | LOC100129534 | NR_024489 | up |
| 17 | chr1 | RER1 | ENST00000434662 | Down |
| 18 | chr1 | PANK4 | NM_018216 | up |
| 19 | chr1 | PANK4 | NM_018216 | up |
| 20 | chr1 | ARHGEF16 | NM_014448 | Down |
| 21 | chr1 | WDR8 | ENST00000378322 | up |
| 22 | chr1 | TP73 | NM_005427 | Down |
| 23 | chr1 | DFFB | AB028912 | Down |
| 24 | chr1 | AJAP1 | NM_018836 | Down |
| 25 | chr1 | NPHP4 | NM_015102 | Down |
| 26 | chr1 | KCNAB2 | NM_003636 | up |
| 27 | chr1 | CHD5 | NM_015557 | Down |
| 28 | chr1 | RNF207 | NM_207396 | Down |
| 29 | chr1 | PLEKHG5 | NM_020631 | Down |
| 30 | chr1 | ZBTB48 | NM_005341 | Down |
| 31 | chr1 | KLHL21 | NM_014851 | up |
| 32 | chr1 | PHF13 | NM_153812 | Down |
| 33 | chr1 | PHF13 | NM_153812 | Down |
| 34 | chr1 | PER3 | NM_016831 | up |
| 35 | chr1 | PARK7 | NM_007262 | Down |
| 36 | chr1 | RERE | NM_012102 | Down |
| 37 | chr1 | CLSTN1 | NM_001009566 | Down |
| 38 | chr1 | LZIC | NM_032368 | Down |
| 39 | chr1 | UBE4B | NM_001105562 | up |
| 40 | chr1 | UBE4B | NM_001105562 | Down |
| 41 | chr1 | C1orf187 | NM_198545 | Down |
| 42 | chr1 | C1orf187 | NM_198545 | up |
| 43 | chr1 | C1orf187 | NM_198545 | up |
| 44 | chr1 | TNFRSF8 | NM_001243 | Down |
| 45 | chr1 | VPS13D | NM_015378 | Down |
| 46 | chr1 | PRDM2 | NM_012231 | Down |
| 47 | chr1 | PRDM2 | NM_015866 | up |
| 48 | chr1 | DNAJC16 | NM_015291 | up |
| 49 | chr1 | AGMAT | NM_024758 | up |
| 50 | chr1 | SPEN | NM_015001 | Down |
| 51 | chr1 | SPEN | NM_015001 | Down |
| 52 | chr1 | EPHA2 | NM_004431 | Down |
| 53 | chr1 | ARHGEF19 | NM_153213 | Down |
| 54 | chr1 | ATP13A2 | NM_022089 | up |
| 55 | chr1 | ATP13A2 | NM_022089 | up |
| 56 | chr1 | SDHB | NM_003000 | up |
| 57 | chr1 | PADI2 | NM_007365 | Down |
| 58 | chr1 | PADI1 | NM_013358 | up |

Fig. 2A-2

| | | | | |
|---|---|---|---|---|
| 59 | chr1 | PADI3 | NM_016233 | Down |
| 60 | chr1 | PADI3 | NM_016233 | Down |
| 61 | chr1 | MRTO4 | NM_016183 | up |
| 62 | chr1 | AKR7A3 | NM_012067 | Down |
| 63 | chr1 | PQLC2 | NM_001040125 | Down |
| 64 | chr1 | PLA2G2E | NM_014589 | Down |
| 65 | chr1 | VWA5B1 | NM_001039500 | up |
| 66 | chr1 | KIF17 | NM_020816 | up |
| 67 | chr1 | EIF4G3 | NM_003760 | Down |
| 68 | chr1 | HSPG2 | NM_005529 | up |
| 69 | chr1 | HSPG2 | NM_005529 | Down |
| 70 | chr1 | HSPG2 | NM_005529 | Down |
| 71 | chr1 | HSPG2 | NM_005529 | up |
| 72 | chr1 | HSPG2 | NM_005529 | up |
| 73 | chr1 | HSPG2 | NM_005529 | Down |
| 74 | chr1 | HSPG2 | NM_005529 | up |
| 75 | chr1 | CELA3B | NM_007352 | Down |
| 76 | chr1 | WNT4 | NM_030761 | up |
| 77 | chr1 | C1QC | NM_001114101 | Down |
| 78 | chr1 | EPHB2 | NM_017449 | Down |
| 79 | chr1 | ASAP3 | NM_017707 | up |
| 80 | chr1 | ASAP3 | NM_017707 | Down |
| 81 | chr1 | MYOM3 | NM_152372 | up |
| 82 | chr1 | MYOM3 | NM_152372 | Down |
| 83 | chr1 | GRHL3 | NM_021180 | Down |
| 84 | chr1 | NIPAL3 | NM_020448 | Down |
| 85 | chr1 | RUNX3 | NM_001031680 | up |
| 86 | chr1 | MAN1C1 | NM_020379 | Down |
| 87 | chr1 | C1orf135 | NM_024037 | up |
| 88 | chr1 | C1orf135 | NM_024037 | Down |
| 89 | chr1 | STMN1 | NM_001145454 | up |
| 90 | chr1 | UBXN11 | NM_145345 | Down |
| 91 | chr1 | PIGV | NM_017837 | up |
| 92 | chr1 | TMEM222 | NM_032125 | up |
| 93 | chr1 | C1orf38 | NM_004848 | Down |
| 94 | chr1 | TMEM200B | NM_001171868 | up |
| 95 | chr1 | MECR | NM_016011 | Down |
| 96 | chr1 | PTPRU | NM_133178 | Down |
| 97 | chr1 | MATN1 | NM_002379 | Down |
| 98 | chr1 | SDC3 | NM_014654 | Down |
| 99 | chr1 | SDC3 | NM_014654 | Down |
| 100 | chr1 | SDC3 | NM_014654 | Down |
| 101 | chr1 | FABP3 | NM_004102 | up |
| 102 | chr1 | COL16A1 | NM_001856 | Down |
| 103 | chr1 | COL16A1 | NM_001856 | up |
| 104 | chr1 | CCDC28B | NM_024296 | Down |
| 105 | chr1 | EIF3I | NM_003757 | Down |
| 106 | chr1 | MARCKSL1 | NM_023009 | Down |
| 107 | chr1 | KIAA1522 | NM_020888 | Down |
| 108 | chr1 | YARS | NM_003680 | Down |
| 109 | chr1 | S100PBP | NM_022753 | Down |

Fig. 2A-3

| | | | | |
|---|---|---|---|---|
| 110 | chr1 | FNDC5 | NM_001171941 | up |
| 111 | chr1 | CSMD2 | NM_052896 | up |
| 112 | chr1 | C1orf94 | NM_001134734 | up |
| 113 | chr1 | LOC653160 | BC021230 | up |
| 114 | chr1 | ZMYM6 | NM_007167 | Down |
| 115 | chr1 | ZMYM4 | NM_005095 | up |
| 116 | chr1 | PSMB2 | NM_002794 | up |
| 117 | chr1 | EIF2C3 | NM_024852 | up |
| 118 | chr1 | TEKT2 | NM_014466 | Down |
| 119 | chr1 | TEKT2 | NM_014466 | Down |
| 120 | chr1 | COL8A2 | NM_005202 | up |
| 121 | chr1 | MAP7D1 | NM_018067 | Down |
| 122 | chr1 | OSCP1 | NM_145047 | up |
| 123 | chr1 | OSCP1 | NM_145047 | up |
| 124 | chr1 | OSCP1 | NM_145047 | up |
| 125 | chr1 | RSPO1 | NM_001038633 | Down |
| 126 | chr1 | C1orf109 | BC018109 | Down |
| 127 | chr1 | CDCA8 | ENST00000373055 | Down |
| 128 | chr1 | POU3F1 | NM_002699 | up |
| 129 | chr1 | MACF1 | NM_012090 | Down |
| 130 | chr1 | PABPC4 | NM_001135653 | up |
| 131 | chr1 | COL9A2 | NM_001852 | Down |
| 132 | chr1 | EDN2 | NM_001956 | up |
| 133 | chr1 | HIVEP3 | NM_024503 | Down |
| 134 | chr1 | FOXJ3 | NM_014947 | Down |
| 135 | chr1 | RIMKLA | NM_173642 | Down |
| 136 | chr1 | LEPRE1 | NM_022356 | up |
| 137 | chr1 | ERMAP | NM_001017922 | up |
| 138 | chr1 | EBNA1BP2 | NM_001159936 | up |
| 139 | chr1 | PTPRF | NM_002840 | up |
| 140 | chr1 | KDM4A | NM_014663 | up |
| 141 | chr1 | ST3GAL3 | NM_174963 | Down |
| 142 | chr1 | ST3GAL3 | NM_174963 | Down |
| 143 | chr1 | DPH2 | NM_001384 | up |
| 144 | chr1 | DPH2 | NM_001384 | up |
| 145 | chr1 | CCDC24 | NM_152499 | up |
| 146 | chr1 | SLC6A9 | NM_006934 | up |
| 147 | chr1 | RNF220 | NM_018150 | up |
| 148 | chr1 | KIF2C | NM_006845 | up |
| 149 | chr1 | PTCH2 | NM_003738 | Down |
| 150 | chr1 | HECTD3 | NM_024602 | Down |
| 151 | chr1 | NASP | NM_172164 | up |
| 152 | chr1 | GPBP1L1 | NM_021639 | up |
| 153 | chr1 | POMGNT1 | NM_017739 | up |

Fig. 2A-4

| | | | | |
|---|---|---|---|---|
| 154 | chr1 | FOXE3 | NM_012186 | Down |
| 155 | chr1 | FOXD2 | NM_004474 | Down |
| 156 | chr1 | RAB3B | NM_002867 | up |
| 157 | chr1 | ZCCHC11 | NM_001009881 | Down |
| 158 | chr1 | GPX7 | NM_015696 | up |
| 159 | chr1 | ZYG11A | NM_001004339 | up |
| 160 | chr1 | SLC1A7 | NM_006671 | up |
| 161 | chr1 | FLJ40434 | NR_002314 | up |
| 162 | chr1 | ACOT11 | NM_015547 | Down |
| 163 | chr1 | C1orf175 | NR_026782 | up |
| 164 | chr1 | TTC4 | NM_004623 | up |
| 165 | chr1 | PPAP2B | NM_003713 | up |
| 166 | chr1 | ALG6 | NM_013339 | up |
| 167 | chr1 | EFCAB7 | NM_032437 | Down |
| 168 | chr1 | ROR1 | NM_005012 | Down |
| 169 | chr1 | ROR1 | NM_005012 | up |
| 170 | chr1 | CACHD1 | NM_020925 | up |
| 171 | chr1 | DNAJC6 | NM_014787 | Down |
| 172 | chr1 | INSL5 | NM_005478 | up |
| 173 | chr1 | MIER1 | NM_020948 | Down |
| 174 | chr1 | CTH | NM_001902 | up |
| 175 | chr1 | ZRANB2 | NM_203350 | up |
| 176 | chr1 | LHX8 | NM_001001933 | Down |
| 177 | chr1 | LHX8 | NM_001001933 | Down |
| 178 | chr1 | ST6GALNAC3 | NM_152996 | Down |
| 179 | chr1 | ELTD1 | NM_022159 | up |
| 180 | chr1 | COL24A1 | NM_152890 | up |
| 181 | chr1 | CLCA2 | NM_006536 | Down |
| 182 | chr1 | BARHL2 | NM_020063 | up |
| 183 | chr1 | BRDT | NM_001726 | up |
| 184 | chr1 | DR1 | NM_001938 | up |
| 185 | chr1 | SLC44A3 | NM_152369 | Down |
| 186 | chr1 | CNN3 | NM_001839 | Down |
| 187 | chr1 | LPPR4 | NM_014839 | up |
| 188 | chr1 | PALMD | NM_017734 | Down |
| 189 | chr1 | HEJ1 | NR_033424 | Down |
| 190 | chr1 | WDR47 | NM_001142550 | up |
| 191 | chr1 | ATXN7L2 | NM_153340 | Down |
| 192 | chr1 | CYB561D1 | NM_182580 | Down |
| 193 | chr1 | EPS8L3 | NM_139053 | up |
| 194 | chr1 | FAM40A | ENST00000369794 | Down |
| 195 | chr1 | FAM40A | NM_033088 | up |
| 196 | chr1 | RBM15 | NM_022768 | Down |
| 197 | chr1 | CHI3L2 | NM_004000 | up |

Fig. 2A-5

| | | | | |
|---|---|---|---|---|
| 198 | chr1 | CHIA | NM_021797 | up |
| 199 | chr1 | CHIA | NM_021797 | Down |
| 200 | chr1 | KCND3 | NM_004980 | up |
| 201 | chr1 | ST7L | NM_017744 | Down |
| 202 | chr1 | MOV10 | NM_020963 | up |
| 203 | chr1 | RHOC | NM_175744 | up |
| 204 | chr1 | ATP1A1 | NM_000701 | Down |
| 205 | chr1 | TTF2 | NM_003594 | Down |
| 206 | chr1 | PHGDH | NM_006623 | up |
| 207 | chr1 | PHGDH | NM_006623 | Down |
| 208 | chr1 | HMGCS2 | NM_005518 | Down |
| 209 | chr1 | NOTCH2 | NM_024408 | up |
| 210 | chr1 | HFE2 | NM_213653 | Down |
| 211 | chr1 | PEX11B | NM_003846 | Down |
| 212 | chr1 | ACP6 | NM_016361 | Down |
| 213 | chr1 | BOLA1 | NM_016074 | up |
| 214 | chr1 | MTMR11 | NM_001145862 | Down |
| 215 | chr1 | OTUD7B | NM_020205 | up |
| 216 | chr1 | C1orf54 | NM_024579 | up |
| 217 | chr1 | ECM1 | NM_004425 | Down |
| 218 | chr1 | ARNT | NM_001668 | Down |
| 219 | chr1 | SETDB1 | NM_001145415 | Down |
| 220 | chr1 | ANXA9 | NM_003568 | up |
| 221 | chr1 | FAM63A | NM_018379 | Down |
| 222 | chr1 | PRUNE | NM_021222 | Down |
| 223 | chr1 | PI4KB | NM_002651 | Down |
| 224 | chr1 | RFX5 | NM_000449 | up |
| 225 | chr1 | RFX5 | NM_000449 | Down |
| 226 | chr1 | CGN | NM_020770 | Down |
| 227 | chr1 | CGN | NM_020770 | up |
| 228 | chr1 | TDRKH | NM_001083965 | up |
| 229 | chr1 | CRNN | NM_016190 | up |
| 230 | chr1 | CRNN | NM_016190 | up |
| 231 | chr1 | SMCP | NM_030663 | Down |
| 232 | chr1 | PGLYRP4 | NM_020393 | Down |
| 233 | chr1 | S100A8 | NM_002964 | up |
| 234 | chr1 | S100A7 | NM_002963 | Down |
| 235 | chr1 | --- | --- | up |
| 236 | chr1 | DENND4B | NM_014856 | up |
| 237 | chr1 | CRTC2 | NM_181715 | Down |
| 238 | chr1 | CREB3L4 | NM_130898 | Down |
| 239 | chr1 | IL6R | NM_000565 | Down |
| 240 | chr1 | IL6R | NM_000565 | Down |
| 241 | chr1 | TDRD10 | NM_001098475 | Down |

Fig. 2A-6

| | | | | |
|---|---|---|---|---|
| 242 | chr1 | ADAR | NM_001111 | up |
| 243 | chr1 | ADAR | NM_001111 | up |
| 244 | chr1 | PYGO2 | NM_138300 | Down |
| 245 | chr1 | SHC1 | NM_183001 | Down |
| 246 | chr1 | DCST2 | NM_144622 | Down |
| 247 | chr1 | ADAM15 | NM_207191 | up |
| 248 | chr1 | ADAM15 | NM_207191 | Down |
| 249 | chr1 | TRIM46 | NM_025058 | Down |
| 250 | chr1 | MUC1 | NM_002456 | up |
| 251 | chr1 | THBS3 | NM_007112 | Down |
| 252 | chr1 | POU5F1P4 | GU480875 | up |
| 253 | chr1 | PAQR6 | NM_024897 | up |
| 254 | chr1 | SMG5 | NM_015327 | up |
| 255 | chr1 | SMG5 | NM_015327 | Down |
| 256 | chr1 | C1orf85 | NM_144580 | up |
| 257 | chr1 | IQGAP3 | NM_178229 | up |
| 258 | chr1 | IQGAP3 | NM_178229 | Down |
| 259 | chr1 | BCAN | NM_198427 | Down |
| 260 | chr1 | NES | NM_006617 | Down |
| 261 | chr1 | NES | NM_006617 | up |
| 262 | chr1 | C1orf66 | NM_015997 | Down |
| 263 | chr1 | HDGF | NM_004494 | Down |
| 264 | chr1 | INSRR | NM_014215 | up |
| 265 | chr1 | NTRK1 | NM_001012331 | Down |
| 266 | chr1 | C1orf92 | NM_144702 | Down |
| 267 | chr1 | FCRL5 | NM_031281 | up |
| 268 | chr1 | OR6N1 | NM_001005185 | up |
| 269 | chr1 | CADM3 | NM_021189 | Down |
| 270 | chr1 | DARC | NM_001122951 | Down |
| 271 | chr1 | IGSF9 | ENST00000198587 | Down |
| 272 | chr1 | DCAF8 | NR_028103 | up |
| 273 | chr1 | LY9 | NM_002348 | up |
| 274 | chr1 | F11R | NM_016946 | Down |
| 275 | chr1 | ARHGAP30 | NM_001025598 | Down |
| 276 | chr1 | ARHGAP30 | NM_001025598 | Down |
| 277 | chr1 | UAP1 | NM_003115 | Down |
| 278 | chr1 | RGS5 | NM_003617 | up |
| 279 | chr1 | FMO9P | NR_002925 | up |
| 280 | chr1 | MGC4473 | NR_024160 | Down |
| 281 | chr1 | F5 | NM_000130 | Down |
| 282 | chr1 | F5 | NM_000130 | Down |
| 283 | chr1 | F5 | NM_000130 | up |
| 284 | chr1 | PIGC | ENST00000367728 | Down |
| 285 | chr1 | TNFSF18 | NM_005092 | up |

Fig. 2A-7

| | | | | |
|---|---|---|---|---|
| 286 | chr1 | RASAL2 | NM_170692 | Down |
| 287 | chr1 | FAM163A | NM_173509 | Down |
| 288 | chr1 | TOR1AIP2 | NM_022347 | up |
| 289 | chr1 | ----- | ----- | Down |
| 290 | chr1 | IER5 | NM_016545 | up |
| 291 | chr1 | CACNA1E | NM_000721 | up |
| 292 | chr1 | CACNA1E | NM_000721 | up |
| 293 | chr1 | GLUL | NM_002065 | up |
| 294 | chr1 | RGSL1 | NM_001137669 | up |
| 295 | chr1 | LAMC1 | NM_002293 | up |
| 296 | chr1 | LAMC2 | NM_005562 | up |
| 297 | chr1 | SMG7 | NM_173156 | Down |
| 298 | chr1 | NCF2 | NM_000433 | up |
| 299 | chr1 | B3GALT2 | NM_003783 | Down |
| 300 | chr1 | NEK7 | NM_133494 | Down |
| 301 | chr1 | CACNA1S | NM_000069 | Down |
| 302 | chr1 | CACNA1S | NM_000069 | Down |
| 303 | chr1 | CACNA1S | NM_000069 | Down |
| 304 | chr1 | CACNA1S | NM_000069 | up |
| 305 | chr1 | IGFN1 | ENST00000412892 | Down |
| 306 | chr1 | LAD1 | NM_005558 | up |
| 307 | chr1 | PRELP | NM_002725 | up |
| 308 | chr1 | REN | NM_000537 | up |
| 309 | chr1 | PLEKHA6 | NM_014935 | up |
| 310 | chr1 | PLEKHA6 | NM_014935 | Down |
| 311 | chr1 | NFASC | NM_001005388 | Down |
| 312 | chr1 | CNTN2 | NM_005076 | Down |
| 313 | chr1 | TMCC2 | ENST00000330675 | Down |
| 314 | chr1 | SLC26A9 | NM_052934 | up |
| 315 | chr1 | IKBKE | NM_014002 | up |
| 316 | chr1 | LGTN | NM_006893 | Down |
| 317 | chr1 | DYRK3 | ENST00000367106 | up |
| 318 | chr1 | PIGR | NM_002644 | Down |
| 319 | chr1 | CD55 | NM_001114752 | Down |
| 320 | chr1 | CD46 | NM_002389 | Down |
| 321 | chr1 | CD46 | NM_002389 | Down |
| 322 | chr1 | PLXNA2 | NM_025179 | Down |
| 323 | chr1 | CAMK1G | NM_020439 | Down |
| 324 | chr1 | TRAF3IP3 | NM_025228 | up |
| 325 | chr1 | RCOR3 | NM_001136223 | Down |
| 326 | chr1 | INTS7 | NM_015434 | Down |
| 327 | chr1 | DTL | NM_016448 | Down |
| 328 | chr1 | ATF3 | NM_001674 | Down |
| 329 | chr1 | USH2A | NM_206933 | up |

Fig. 2A-8

| | | | | |
|---|---|---|---|---|
| 330 | chr1 | MARK1 | NM_018650 | up |
| 331 | chr1 | MARK1 | NM_018650 | Down |
| 332 | chr1 | MARK1 | NM_018650 | Down |
| 333 | chr1 | C1orf65 | NM_152610 | up |
| 334 | chr1 | TP53BP2 | NM_001031685 | up |
| 335 | chr1 | TMEM63A | NM_014698 | up |
| 336 | chr1 | TMEM63A | NM_014698 | Down |
| 337 | chr1 | PYCR2 | NM_013328 | up |
| 338 | chr1 | ACBD3 | NM_022735 | up |
| 339 | chr1 | WNT9A | NM_003395 | up |
| 340 | chr1 | C1orf35 | NM_024319 | Down |
| 341 | chr1 | OBSCN | NM_052843 | Down |
| 342 | chr1 | OBSCN | NM_052843 | up |
| 343 | chr1 | TRIM17 | NM_016102 | Down |
| 344 | chr1 | EDARADD | NM_080738 | Down |
| 345 | chr1 | MTR | NM_000254 | Down |
| 346 | chr1 | RYR2 | NM_001035 | Down |
| 347 | chr1 | HNRNPU | NM_031844 | up |
| 348 | chr1 | SCCPDH | NM_016002 | up |
| 349 | chr1 | ZNF669 | NM_024804 | up |
| 350 | chr1 | NLRP3 | NM_004895 | Down |
| 351 | chr1 | OR9H1P | AY358215 | Down |
| 352 | chr1 | TRIM58 | NM_015431 | up |
| 353 | chr1 | OR2T12 | NM_001004692 | Down |
| 354 | chr1 | ZNF672 | NM_024836 | Down |
| 355 | chr2 | MYT1L | NM_015025 | up |
| 356 | chr2 | MYT1L | NM_015025 | up |
| 357 | chr2 | TSSC1 | NM_003310 | up |
| 358 | chr2 | TTC15 | NM_016030 | up |
| 359 | chr2 | SOX11 | NM_003108 | up |
| 360 | chr2 | CMPK2 | NM_207315 | up |
| 361 | chr2 | RSAD2 | NM_080657 | Down |
| 362 | chr2 | ASAP2 | NM_003887 | up |
| 363 | chr2 | ASAP2 | NM_003887 | up |
| 364 | chr2 | ASAP2 | NM_003887 | Down |
| 365 | chr2 | HPCAL1 | NM_002149 | up |
| 366 | chr2 | HPCAL1 | NM_134421 | up |
| 367 | chr2 | ATP6V1C2 | AK127836 | Down |
| 368 | chr2 | GREB1 | NM_014668 | Down |
| 369 | chr2 | RDH14 | NM_020905 | up |
| 370 | chr2 | HS1BP3 | NM_022460 | up |
| 371 | chr2 | HS1BP3 | NM_022460 | Down |
| 372 | chr2 | APOB | NM_000384 | Down |
| 373 | chr2 | APOB | NM_000384 | Down |

Fig. 2A-9

| | | | | |
|---|---|---|---|---|
| 374 | chr2 | KLHL29 | NM_052920 | Down |
| 375 | chr2 | UBXN2A | NM_181713 | up |
| 376 | chr2 | CENPO | NM_024322 | up |
| 377 | chr2 | ADCY3 | NM_004036 | Down |
| 378 | chr2 | DNMT3A | NM_175629 | up |
| 379 | chr2 | DTNB | NM_021907 | Down |
| 380 | chr2 | GPR113 | NM_001145168 | Down |
| 381 | chr2 | C2orf28 | NM_080592 | up |
| 382 | chr2 | CAD | NM_004341 | Down |
| 383 | chr2 | ZNF513 | NM_144631 | Down |
| 384 | chr2 | NRBP1 | NM_013392 | Down |
| 385 | chr2 | KRTCAP3 | NM_001168364 | up |
| 386 | chr2 | SUPT7L | NM_014860 | Down |
| 387 | chr2 | PLB1 | NM_153021 | Down |
| 388 | chr2 | LCLAT1 | NM_182551 | up |
| 389 | chr2 | GALNT14 | NM_024572 | Down |
| 390 | chr2 | SPAST | NM_014946 | up |
| 391 | chr2 | MYADML | NR_003143 | up |
| 392 | chr2 | MYADML | NR_003143 | up |
| 393 | chr2 | C2orf56 | NM_144736 | Down |
| 394 | chr2 | SOS1 | NM_005633 | Down |
| 395 | chr2 | KCNG3 | NM_133329 | Down |
| 396 | chr2 | OXER1 | NM_148962 | Down |
| 397 | chr2 | ZFP36L2 | NM_006887 | Down |
| 398 | chr2 | EPAS1 | NM_001430 | Down |
| 399 | chr2 | KCNK12 | NM_022055 | up |
| 400 | chr2 | MSH6 | NM_000179 | up |
| 401 | chr2 | RTN4 | NM_207521 | up |
| 402 | chr2 | SMEK2 | NM_001122964 | Down |
| 403 | chr2 | KIAA1841 | NM_032506 | Down |
| 404 | chr2 | USP34 | NM_014709 | up |
| 405 | chr2 | OTX1 | NM_014562 | Down |
| 406 | chr2 | C2orf86 | NM_001042692 | Down |
| 407 | chr2 | ARHGAP25 | NM_001007231 | Down |
| 408 | chr2 | ANTXR1 | NM_032208 | up |
| 409 | chr2 | GMCL1 | NM_178439 | Down |
| 410 | chr2 | ADD2 | NM_017482 | Down |
| 411 | chr2 | ADD2 | NM_001617 | up |
| 412 | chr2 | CD207 | NM_015717 | up |
| 413 | chr2 | VAX2 | NM_012476 | Down |
| 414 | chr2 | ANKRD53 | NM_001115116 | up |
| 415 | chr2 | MPHOSPH10 | NM_005791 | Down |
| 416 | chr2 | RAB11FIP5 | NM_015470 | up |
| 417 | chr2 | ALMS1P | NR_003683 | up |

Fig. 2A-10

| | | | | |
|---|---|---|---|---|
| 418 | chr2 | INO80B | NM_031288 | Down |
| 419 | chr2 | MOGS | NM_006302 | Down |
| 420 | chr2 | AUP1 | NM_181575 | Down |
| 421 | chr2 | LRRTM1 | ENST00000433224 | Down |
| 422 | chr2 | FUNDC2P2 | NR_003663 | Down |
| 423 | chr2 | TMSB10 | NM_021103 | up |
| 424 | chr2 | KCMF1 | NM_020122 | up |
| 425 | chr2 | TGOLN2 | NM_006464 | up |
| 426 | chr2 | SH2D6 | NM_198482 | up |
| 427 | chr2 | USP39 | NM_006590 | up |
| 428 | chr2 | SMYD1 | NM_198274 | up |
| 429 | chr2 | --- | --- | up |
| 430 | chr2 | --- | --- | up |
| 431 | chr2 | ARID5A | NM_212481 | Down |
| 432 | chr2 | ANKRD23 | NM_144994 | Down |
| 433 | chr2 | FAM178B | NM_001122646 | Down |
| 434 | chr2 | ACTR1B | NM_005735 | up |
| 435 | chr2 | AFF3 | NM_002285 | up |
| 436 | chr2 | LONRF2 | NM_198461 | Down |
| 437 | chr2 | CHST10 | NM_004854 | Down |
| 438 | chr2 | NPAS2 | NM_002518 | up |
| 439 | chr2 | TBC1D8 | NM_001102426 | Down |
| 440 | chr2 | RNF149 | NM_173647 | Down |
| 441 | chr2 | IL18RAP | NM_003853 | up |
| 442 | chr2 | SLC9A2 | NM_003048 | Down |
| 443 | chr2 | MRPS9 | NM_182640 | up |
| 444 | chr2 | UXS1 | ENST00000409032 | Down |
| 445 | chr2 | FBLN7 | NM_153214 | up |
| 446 | chr2 | FBLN7 | NM_153214 | Down |
| 447 | chr2 | IL1F7 | NM_014439 | Down |
| 448 | chr2 | IL1F10 | NM_032556 | Down |
| 449 | chr2 | SLC35F5 | NM_025181 | up |
| 450 | chr2 | SCTR | NM_002980 | Down |
| 451 | chr2 | TMEM177 | NM_001105198 | up |
| 452 | chr2 | EPB41L5 | NM_020909 | up |
| 453 | chr2 | LOC84931 | NR_027181 | up |
| 454 | chr2 | TFCP2L1 | NM_014553 | up |
| 455 | chr2 | CYP27C1 | NM_001001665 | up |
| 456 | chr2 | AMMECR1L | NM_031445 | Down |
| 457 | chr2 | LOC401010 | NR_002826 | up |
| 458 | chr2 | MGAT5 | NM_002410 | Down |
| 459 | chr2 | TMEM163 | NM_030923 | up |
| 460 | chr2 | ZRANB3 | ENST00000412849 | up |
| 461 | chr2 | --- | --- | Down |

Fig. 2A-11

| | | | | |
|---|---|---|---|---|
| 462 | chr2 | LCT | NM_002299 | up |
| 463 | chr2 | LRP1B | NM_018557 | up |
| 464 | chr2 | LRP1B | NM_018557 | up |
| 465 | chr2 | LRP1B | NM_018557 | Down |
| 466 | chr2 | ZEB2 | NM_014795 | Down |
| 467 | chr2 | ZEB2 | NM_014795 | Down |
| 468 | chr2 | KIF5C | NM_004522 | Down |
| 469 | chr2 | NEB | NM_001164507 | up |
| 470 | chr2 | CACNB4 | NM_001005747 | up |
| 471 | chr2 | TBR1 | NM_006593 | Down |
| 472 | chr2 | TBR1 | NM_006593 | Down |
| 473 | chr2 | GRB14 | NM_004490 | up |
| 474 | chr2 | ABCB11 | NM_003742 | up |
| 475 | chr2 | LRP2 | NM_004525 | Down |
| 476 | chr2 | METTL8 | ENST00000375258 | Down |
| 477 | chr2 | SLC25A12 | NM_003705 | Down |
| 478 | chr2 | DLX2 | NM_004405 | Down |
| 479 | chr2 | ITGAV | NM_002210 | Down |
| 480 | chr2 | COL3A1 | NM_000090 | Down |
| 481 | chr2 | COL3A1 | NM_000090 | up |
| 482 | chr2 | COL3A1 | NM_000090 | up |
| 483 | chr2 | COL5A2 | NM_000393 | up |
| 484 | chr2 | NAB1 | NM_005966 | up |
| 485 | chr2 | STAT1 | NM_007315 | up |
| 486 | chr2 | MARS2 | NM_138395 | up |
| 487 | chr2 | ALS2CR11 | NM_001168221 | Down |
| 488 | chr2 | ALS2 | NM_020919 | up |
| 489 | chr2 | BMPR2 | NM_001204 | up |
| 490 | chr2 | PARD3B | NM_205863 | up |
| 491 | chr2 | PARD3B | NM_205863 | up |
| 492 | chr2 | INO80D | NM_017759 | Down |
| 493 | chr2 | KLF7 | NM_003709 | up |
| 494 | chr2 | FZD5 | NM_003468 | up |
| 495 | chr2 | FZD5 | NM_003468 | up |
| 496 | chr2 | MAP2 | NM_002374 | Down |
| 497 | chr2 | SPAG16 | NM_024532 | up |
| 498 | chr2 | FN1 | NM_212482 | up |
| 499 | chr2 | TMEM169 | NM_001142310 | Down |
| 500 | chr2 | SMARCAL1 | NM_014140 | Down |
| 501 | chr2 | RUFY4 | NM_198483 | Down |
| 502 | chr2 | ARPC2 | NM_152862 | Down |
| 503 | chr2 | GPBAR1 | NM_001077191 | Down |
| 504 | chr2 | GPBAR1 | NM_001077191 | Down |
| 505 | chr2 | STK36 | NM_015690 | Down |

Fig. 2A-12

| | | | | |
|---|---|---|---|---|
| 506 | chr2 | STK36 | NM_015690 | up |
| 507 | chr2 | STK36 | NM_015690 | up |
| 508 | chr2 | PRKAG3 | NM_017431 | up |
| 509 | chr2 | WNT10A | NM_025216 | up |
| 510 | chr2 | FEV | NM_017521 | Down |
| 511 | chr2 | CRYBA2 | NM_057093 | Down |
| 512 | chr2 | CCDC108 | NM_194302 | Down |
| 513 | chr2 | ABCB6 | NM_005689 | Down |
| 514 | chr2 | DNAJB2 | NM_006736 | Down |
| 515 | chr2 | PTPRN | NM_002846 | Down |
| 516 | chr2 | DES | NM_001927 | up |
| 517 | chr2 | SPEG | NM_005876 | Down |
| 518 | chr2 | CHPF | NM_024536 | up |
| 519 | chr2 | STK11IP | NM_052902 | Down |
| 520 | chr2 | PAX3 | NM_000438 | Down |
| 521 | chr2 | COL4A4 | NM_000092 | Down |
| 522 | chr2 | COL4A3 | NM_000091 | up |
| 523 | chr2 | COL4A3 | NM_000091 | up |
| 524 | chr2 | SLC19A3 | NM_025243 | up |
| 525 | chr2 | PID1 | NM_017933 | Down |
| 526 | chr2 | DNER | NM_139072 | up |
| 527 | chr2 | TRIP12 | NM_004238 | Down |
| 528 | chr2 | SP140 | NM_007237 | Down |
| 529 | chr2 | SP140L | NM_138402 | up |
| 530 | chr2 | ARMC9 | NM_025139 | up |
| 531 | chr2 | NGEF | NM_019850 | up |
| 532 | chr2 | SAG | NM_000541 | Down |
| 533 | chr2 | DGKD | NM_003648 | Down |
| 534 | chr2 | DGKD | NM_003648 | up |
| 535 | chr2 | ARL4C | NM_005737 | up |
| 536 | chr2 | COL6A3 | NM_004369 | up |
| 537 | chr2 | RAMP1 | NM_005855 | Down |
| 538 | chr2 | PER2 | NM_022817 | up |
| 539 | chr2 | TRAF3IP1 | AF242456 | Down |
| 540 | chr2 | TRAF3IP1 | NM_015650 | Down |
| 541 | chr2 | ASB1 | NM_001040445 | up |
| 542 | chr2 | HDAC4 | NM_006037 | Down |
| 543 | chr2 | HDAC4 | NM_006037 | Down |
| 544 | chr2 | NDUFA10 | NM_004544 | Down |
| 545 | chr2 | GPC1 | NM_002081 | Down |
| 546 | chr2 | SNED1 | NM_001080437 | up |
| 547 | chr2 | SNED1 | NM_001080437 | Down |
| 548 | chr2 | PPP1R7 | NM_002712 | Down |
| 549 | chr2 | 2-Sep | ENST00000429791 | Down |

Fig. 2A-13

| | | | | |
|---|---|---|---|---|
| 550 | chr2 | --- | --- | Down |
| 551 | chr2 | --- | --- | Down |
| 552 | chr2 | --- | --- | Down |
| 553 | chr2 | C2orf85 | NM_173821 | Down |
| 554 | chr2 | FLJ40712 | AK098031 | up |
| 555 | chr3 | ITPR1 | NM_001099952 | Down |
| 556 | chr3 | ARL8B | NM_018184 | Down |
| 557 | chr3 | GRM7 | NM_000844 | up |
| 558 | chr3 | CAMK1 | NM_003656 | up |
| 559 | chr3 | IL17RC | NM_153461 | Down |
| 560 | chr3 | FANCD2 | NM_033084 | up |
| 561 | chr3 | IRAK2 | NM_001570 | Down |
| 562 | chr3 | TATDN2 | NM_014760 | Down |
| 563 | chr3 | ATP2B2 | NM_001001331 | Down |
| 564 | chr3 | SLC6A11 | NM_014229 | Down |
| 565 | chr3 | SYN2 | NM_133625 | up |
| 566 | chr3 | TMEM40 | NM_018306 | up |
| 567 | chr3 | IQSEC1 | ENST00000450726 | Down |
| 568 | chr3 | NUP210 | BC067089 | Down |
| 569 | chr3 | NUP210 | NM_024923 | Down |
| 570 | chr3 | NUP210 | NM_024923 | up |
| 571 | chr3 | C3orf20 | BC030599 | up |
| 572 | chr3 | EAF1 | NM_033083 | Down |
| 573 | chr3 | COLQ | NM_005677 | Down |
| 574 | chr3 | TBC1D5 | NM_001134381 | Down |
| 575 | chr3 | THRB | NM_000461 | Down |
| 576 | chr3 | TOP2B | NM_001068 | up |
| 577 | chr3 | AZI2 | NM_022461 | Down |
| 578 | chr3 | CCR4 | NM_005508 | Down |
| 579 | chr3 | UBP1 | NM_014517 | Down |
| 580 | chr3 | PDCD6IP | NM_013374 | Down |
| 581 | chr3 | LRRFIP2 | NM_006309 | up |
| 582 | chr3 | VILL | NM_015873 | up |
| 583 | chr3 | PLCD1 | NM_001130964 | Down |
| 584 | chr3 | DLEC1 | BC129824 | up |
| 585 | chr3 | XYLB | NM_005108 | Down |
| 586 | chr3 | ACVR2B | NM_001106 | Down |
| 587 | chr3 | SCN5A | NM_198056 | up |
| 588 | chr3 | CSRNP1 | AB063301 | up |
| 589 | chr3 | XIRP1 | NM_194293 | Down |
| 590 | chr3 | MYRIP | NM_015460 | up |
| 591 | chr3 | ZNF619 | NM_001145082 | up |
| 592 | chr3 | ZNF621 | NM_198484 | up |
| 593 | chr3 | CCK | NM_000729 | Down |

Fig. 2A-14

| | | | | |
|---|---|---|---|---|
| 594 | chr3 | VIPR1 | NM_004624 | Down |
| 595 | chr3 | VIPR1 | NM_004624 | up |
| 596 | chr3 | C3orf23 | NM_173826 | Down |
| 597 | chr3 | ZNF167 | NM_018651 | Down |
| 598 | chr3 | LTF | NM_002343 | up |
| 599 | chr3 | LRRC2 | NM_024750 | up |
| 600 | chr3 | ALS2CL | NM_147129 | Down |
| 601 | chr3 | NBEAL2 | NM_015175 | Down |
| 602 | chr3 | SETD2 | NM_014159 | up |
| 603 | chr3 | PTPN23 | NM_015466 | up |
| 604 | chr3 | PTPN23 | NM_015466 | Down |
| 605 | chr3 | SCAP | NM_012235 | up |
| 606 | chr3 | FBXW12 | NM_207102 | up |
| 607 | chr3 | PLXNB1 | NM_002673 | up |
| 608 | chr3 | --- | --- | up |
| 609 | chr3 | SHISA5 | NM_016479 | up |
| 610 | chr3 | COL7A1 | NM_000094 | up |
| 611 | chr3 | COL7A1 | NM_000094 | up |
| 612 | chr3 | COL7A1 | NM_000094 | Down |
| 613 | chr3 | COL7A1 | NM_000094 | up |
| 614 | chr3 | IP6K2 | NR_027437 | up |
| 615 | chr3 | WDR6 | NM_018031 | Down |
| 616 | chr3 | WDR6 | NM_018031 | Down |
| 617 | chr3 | QARS | NM_005051 | Down |
| 618 | chr3 | CCDC36 | NM_178173 | Down |
| 619 | chr3 | --- | --- | Down |
| 620 | chr3 | --- | --- | Down |
| 621 | chr3 | AMT | NM_000481 | Down |
| 622 | chr3 | RNF123 | NM_022064 | Down |
| 623 | chr3 | MST1R | NM_002447 | Down |
| 624 | chr3 | RBM5 | NM_005778 | Down |
| 625 | chr3 | SEMA3F | NM_004186 | up |
| 626 | chr3 | GNAT1 | NM_144499 | up |
| 627 | chr3 | GNAI2 | NM_002070 | Down |
| 628 | chr3 | GNAI2 | NM_002070 | Down |
| 629 | chr3 | SEMA3B | NM_004636 | Down |
| 630 | chr3 | SEMA3B | NM_004636 | Down |
| 631 | chr3 | IFRD2 | NM_006764 | up |
| 632 | chr3 | HYAL3 | NM_003549 | Down |
| 633 | chr3 | CACNA2D2 | NM_001005505 | Down |
| 634 | chr3 | MAPKAPK3 | NM_004635 | up |
| 635 | chr3 | DOCK3 | NM_004947 | Down |
| 636 | chr3 | TEX264 | NM_015926 | Down |
| 637 | chr3 | PARP3 | NM_001003931 | up |

Fig. 2A-15

| | | | | |
|---|---|---|---|---|
| 638 | chr3 | ACY1 | NM_000666 | Down |
| 639 | chr3 | TLR9 | NM_017442 | Down |
| 640 | chr3 | TWF2 | NM_007284 | Down |
| 641 | chr3 | DNAH1 | NM_015512 | up |
| 642 | chr3 | SEMA3G | NM_020163 | Down |
| 643 | chr3 | NISCH | NM_007184 | up |
| 644 | chr3 | STAB1 | NM_015136 | Down |
| 645 | chr3 | NT5DC2 | NM_022908 | up |
| 646 | chr3 | PBRM1 | NM_018165 | up |
| 647 | chr3 | ITIH3 | NM_002217 | Down |
| 648 | chr3 | SFMBT1 | NM_001005159 | Down |
| 649 | chr3 | RFT1 | NM_052859 | up |
| 650 | chr3 | WNT5A | NM_003392 | up |
| 651 | chr3 | APPL1 | NM_012096 | up |
| 652 | chr3 | FEZF2 | NM_018008 | up |
| 653 | chr3 | MITF | NM_198159 | Down |
| 654 | chr3 | EIF4E3 | NM_173359 | Down |
| 655 | chr3 | GPR27 | NM_018971 | Down |
| 656 | chr3 | TFG | NM_006070 | Down |
| 657 | chr3 | ABI3BP | NM_015429 | up |
| 658 | chr3 | ZBTB11 | NM_014415 | up |
| 659 | chr3 | FAM55C | NM_001134456 | up |
| 660 | chr3 | NFKBIZ | NM_031419 | up |
| 661 | chr3 | ALCAM | NM_001627 | up |
| 662 | chr3 | CD47 | NM_001777 | Down |
| 663 | chr3 | CD47 | NM_001777 | Down |
| 664 | chr3 | DZIP3 | NM_014648 | up |
| 665 | chr3 | C3orf52 | NM_001171747 | up |
| 666 | chr3 | ATP6V1A | NM_001690 | Down |
| 667 | chr3 | UPK1B | NM_006952 | up |
| 668 | chr3 | C3orf1 | NM_016589 | Down |
| 669 | chr3 | POLQ | NM_199420 | up |
| 670 | chr3 | PARP14 | NM_017554 | Down |
| 671 | chr3 | SEMA5B | NM_001031702 | Down |
| 672 | chr3 | PDIA5 | NM_006810 | Down |
| 673 | chr3 | ADCY5 | NM_183357 | Down |
| 674 | chr3 | ADCY5 | NM_183357 | Down |
| 675 | chr3 | ADCY5 | NM_183357 | up |
| 676 | chr3 | MGLL | NM_007283 | Down |
| 677 | chr3 | SEC61A1 | NM_013336 | up |
| 678 | chr3 | RUVBL1 | NM_003707 | up |
| 679 | chr3 | GATA2 | NM_032638 | Down |
| 680 | chr3 | C3orf27 | NM_007354 | Down |
| 681 | chr3 | ACAD9 | NM_014049 | Down |

Fig. 2A-16

| | | | | |
|---|---|---|---|---|
| 682 | chr3 | C3orf25 | BC066975 | Down |
| 683 | chr3 | IFT122 | NM_052985 | up |
| 684 | chr3 | PLXND1 | NM_015103 | up |
| 685 | chr3 | ATP2C1 | NM_014382 | up |
| 686 | chr3 | ASTE1 | NM_014065 | up |
| 687 | chr3 | DNAJC13 | NM_015268 | up |
| 688 | chr3 | ---- | ---- | Down |
| 689 | chr3 | BFSP2 | NM_003571 | Down |
| 690 | chr3 | BFSP2 | NM_003571 | Down |
| 691 | chr3 | AMOTL2 | NM_016201 | up |
| 692 | chr3 | EPHB1 | NM_004441 | Down |
| 693 | chr3 | MRAS | NM_012219 | Down |
| 694 | chr3 | FOXL2 | NM_023067 | Down |
| 695 | chr3 | GK5 | NM_001039547 | up |
| 696 | chr3 | CHST2 | ENST00000309575 | Down |
| 697 | chr3 | CHST2 | NM_004267 | Down |
| 698 | chr3 | SLC9A9 | NM_173653 | Down |
| 699 | chr3 | WWTR1 | NM_015472 | Down |
| 700 | chr3 | EIF2A | NM_032025 | Down |
| 701 | chr3 | LEKR1 | NM_001004316 | up |
| 702 | chr3 | SCHIP1 | NM_014575 | up |
| 703 | chr3 | SCHIP1 | ENST00000445224 | up |
| 704 | chr3 | SMC4 | NM_005496 | up |
| 705 | chr3 | MECOM | NM_001105077 | Down |
| 706 | chr3 | LRRC31 | NM_024727 | Down |
| 707 | chr3 | GHSR | NM_004122 | up |
| 708 | chr3 | ZNF639 | BC026181 | Down |
| 709 | chr3 | MCF2L2 | NM_015078 | Down |
| 710 | chr3 | EIF2B5 | NM_003907 | up |
| 711 | chr3 | ABCF3 | NM_018358 | up |
| 712 | chr3 | ABCF3 | NM_018358 | up |
| 713 | chr3 | ECE2 | NM_014693 | Down |
| 714 | chr3 | CLCN2 | NM_004366 | Down |
| 715 | chr3 | SENP2 | NM_021627 | Down |
| 716 | chr3 | RTP1 | NM_153708 | up |
| 717 | chr3 | MASP1 | NM_001879 | Down |
| 718 | chr3 | BCL6 | NM_001706 | up |
| 719 | chr3 | LEPREL1 | NM_018192 | up |
| 720 | chr3 | CLDN1 | NM_021101 | Down |
| 721 | chr3 | ATP13A4 | NM_032279 | up |
| 722 | chr3 | HES1 | NM_005524 | Down |
| 723 | chr3 | GP5 | NM_004488 | Down |
| 724 | chr3 | FAM43A | NM_153690 | Down |
| 725 | chr3 | ACAP2 | NM_012287 | up |

Fig. 2A-17

| | | | | |
|---|---|---|---|---|
| 726 | chr3 | MUC20 | NM_152673 | Down |
| 727 | chr3 | MUC4 | NM_018406 | Down |
| 728 | chr3 | MUC4 | NM_018406 | Down |
| 729 | chr3 | TM4SF19 | NM_138461 | up |
| 730 | chr3 | WDR53 | NM_182627 | up |
| 731 | chr3 | NCBP2 | NM_007362 | up |
| 732 | chr3 | LOC152217 | NR_024388 | Down |
| 733 | chr4 | PDE6B | NM_000283 | Down |
| 734 | chr4 | GAK | NM_005255 | up |
| 735 | chr4 | DGKQ | NM_001347 | up |
| 736 | chr4 | IDUA | NM_000203 | up |
| 737 | chr4 | WHSC1 | NM_133334 | Down |
| 738 | chr4 | WHSC2 | NM_005663 | Down |
| 739 | chr4 | POLN | NM_181808 | Down |
| 740 | chr4 | RNF4 | NM_002938 | Down |
| 741 | chr4 | TNIP2 | NM_024309 | Down |
| 742 | chr4 | MFSD10 | NM_001120 | up |
| 743 | chr4 | NOP14 | NM_003703 | Down |
| 744 | chr4 | HTT | NM_002111 | Down |
| 745 | chr4 | RGS12 | NM_198229 | Down |
| 746 | chr4 | DOK7 | NM_173660 | Down |
| 747 | chr4 | LYAR | NM_017816 | Down |
| 748 | chr4 | D4S234E | NM_014392 | Down |
| 749 | chr4 | CYTL1 | NM_018659 | up |
| 750 | chr4 | MAN2B2 | NM_015274 | Down |
| 751 | chr4 | GRPEL1 | NM_025196 | Down |
| 752 | chr4 | ABLIM2 | NM_001130083 | up |
| 753 | chr4 | ACOX3 | NM_003501 | Down |
| 754 | chr4 | ACOX3 | NM_003501 | up |
| 755 | chr4 | FBXL5 | NM_012161 | Down |
| 756 | chr4 | TLR10 | NM_030956 | Down |
| 757 | chr4 | TMEM156 | NM_024943 | up |
| 758 | chr4 | LOC401127 | NR_026854 | up |
| 759 | chr4 | RHOH | NM_004310 | Down |
| 760 | chr4 | APBB2 | NM_004307 | Down |
| 761 | chr4 | LIMCH1 | NM_014988 | up |
| 762 | chr4 | GABRA4 | NM_000809 | Down |
| 763 | chr4 | GABRA4 | NM_000809 | up |
| 764 | chr4 | TXK | NM_003328 | up |
| 765 | chr4 | KDR | NM_002253 | Down |
| 766 | chr4 | SRD5A3 | NM_024592 | Down |
| 767 | chr4 | HOPX | NM_001145460 | Down |
| 768 | chr4 | HOPX | NM_032495 | up |
| 769 | chr4 | LPHN3 | NM_015236 | up |

Fig. 2A-18

| | | | | |
|---|---|---|---|---|
| 770 | chr4 | TMPRSS11B | NM_182502 | up |
| 771 | chr4 | CXCL5 | NM_002994 | Down |
| 772 | chr4 | ART3 | NM_001130016 | Down |
| 773 | chr4 | PRKG2 | NM_006259 | up |
| 774 | chr4 | HNRPDL | NM_031372 | up |
| 775 | chr4 | HPSE | NM_006665 | Down |
| 776 | chr4 | HPSE | NM_006665 | Down |
| 777 | chr4 | FAM175A | NM_139076 | Down |
| 778 | chr4 | WDFY3 | NM_014991 | Down |
| 779 | chr4 | MMRN1 | NM_007351 | Down |
| 780 | chr4 | ADH1B | NM_000668 | Down |
| 781 | chr4 | MAPKSP1 | NM_021970 | up |
| 782 | chr4 | H2AFZ | NM_002106 | up |
| 783 | chr4 | MANBA | NM_005908 | up |
| 784 | chr4 | LEF1 | NM_016269 | Down |
| 785 | chr4 | COL25A1 | NM_198721 | up |
| 786 | chr4 | CFI | NM_000204 | Down |
| 787 | chr4 | LRIT3 | NM_198506 | up |
| 788 | chr4 | ENPEP | NM_001977 | Down |
| 789 | chr4 | PITX2 | NM_000325 | Down |
| 790 | chr4 | EXOSC9 | NM_001034194 | Down |
| 791 | chr4 | TRPC3 | NM_001130698 | up |
| 792 | chr4 | MGST2 | NM_002413 | up |
| 793 | chr4 | SCOC | NM_001153484 | up |
| 794 | chr4 | UCP1 | NM_021833 | up |
| 795 | chr4 | UCP1 | NM_021833 | up |
| 796 | chr4 | NR3C2 | NM_000901 | Down |
| 797 | chr4 | TMEM154 | NM_152680 | up |
| 798 | chr4 | TRIM2 | NM_015271 | Down |
| 799 | chr4 | DCHS2 | NM_001142552 | Down |
| 800 | chr4 | RAPGEF2 | NM_014247 | up |
| 801 | chr4 | TLL1 | NM_012464 | Down |
| 802 | chr4 | TLL1 | NM_012464 | Down |
| 803 | chr4 | PALLD | NM_001166108 | Down |
| 804 | chr4 | HMGB2 | NM_002129 | Down |
| 805 | chr4 | VEGFC | NM_005429 | Down |
| 806 | chr4 | VEGFC | NM_005429 | up |
| 807 | chr4 | PDLIM3 | NM_014476 | Down |
| 808 | chr4 | SORBS2 | NM_001145671 | Down |
| 809 | chr4 | FAT1 | NM_005245 | Down |
| 810 | chr5 | FLJ44896 | AK126844 | up |
| 811 | chr5 | PDCD6 | AK295082 | Down |
| 812 | chr5 | AHRR | NM_020731 | Down |
| 813 | chr5 | EXOC3 | NM_007277 | Down |

Fig. 2A-19

| | | | | |
|---|---|---|---|---|
| 814 | chr5 | CEP72 | NM_018140 | up |
| 815 | chr5 | TPPP | NM_007030 | up |
| 816 | chr5 | NKD2 | NM_033120 | Down |
| 817 | chr5 | CLPTM1L | NM_030782 | up |
| 818 | chr5 | SLC6A3 | NM_001044 | up |
| 819 | chr5 | NDUFS6 | NM_004553 | up |
| 820 | chr5 | NSUN2 | NM_017755 | Down |
| 821 | chr5 | ADCY2 | NM_020546 | up |
| 822 | chr5 | SEMA5A | NM_003966 | up |
| 823 | chr5 | CDH18 | NM_004934 | up |
| 824 | chr5 | RNASEN | NM_013235 | Down |
| 825 | chr5 | DNAJC21 | NM_194283 | Down |
| 826 | chr5 | DNAJC21 | NM_194283 | up |
| 827 | chr5 | PRLR | NM_000949 | up |
| 828 | chr5 | EGFLAM | NM_152403 | Down |
| 829 | chr5 | SEPP1 | NM_005410 | Down |
| 830 | chr5 | NNT | NM_012343 | up |
| 831 | chr5 | SNX18 | NM_001102575 | Down |
| 832 | chr5 | PDE4D | AY245867 | Down |
| 833 | chr5 | SFRS12 | NM_001077199 | Down |
| 834 | chr5 | MAST4 | NM_198828 | Down |
| 835 | chr5 | SLC30A5 | NM_022902 | up |
| 836 | chr5 | BDP1 | NM_018429 | up |
| 837 | chr5 | MCCC2 | NM_022132 | Down |
| 838 | chr5 | PTCD2 | NM_024754 | Down |
| 839 | chr5 | POLK | BC050718 | Down |
| 840 | chr5 | IQGAP2 | NM_006633 | Down |
| 841 | chr5 | F2R | NM_001992 | Down |
| 842 | chr5 | RASGRF2 | NM_006909 | up |
| 843 | chr5 | ZCCHC9 | NM_032280 | Down |
| 844 | chr5 | RASA1 | NM_002890 | Down |
| 845 | chr5 | POU5F2 | NM_153216 | Down |
| 846 | chr5 | GPR150 | NM_199243 | up |
| 847 | chr5 | SLCO4C1 | NM_180991 | Down |
| 848 | chr5 | GIN1 | NM_017676 | Down |
| 849 | chr5 | FBXL17 | NM_001163315 | up |
| 850 | chr5 | PJA2 | NM_014819 | Down |
| 851 | chr5 | EPB41L4A | NM_022140 | Down |
| 852 | chr5 | EPB41L4A | NM_022140 | up |
| 853 | chr5 | DMXL1 | NM_005509 | Down |
| 854 | chr5 | PRR16 | NM_016644 | Down |
| 855 | chr5 | SNCAIP | NM_005460 | up |
| 856 | chr5 | ALDH7A1 | NM_001182 | up |
| 857 | chr5 | MEGF10 | NM_032446 | Down |

Fig. 2A-20

| | | | | |
|---|---|---|---|---|
| 858 | chr5 | ISOC1 | NM_016048 | Down |
| 859 | chr5 | ISOC1 | NM_016048 | up |
| 860 | chr5 | ADAMTS19 | NM_133638 | up |
| 861 | chr5 | ACSL6 | NM_015256 | up |
| 862 | chr5 | PDLIM4 | NM_003687 | Down |
| 863 | chr5 | RAD50 | NM_005732 | up |
| 864 | chr5 | AFF4 | NM_014423 | up |
| 865 | chr5 | ZCCHC10 | NM_017665 | up |
| 866 | chr5 | C5orf15 | NM_020199 | up |
| 867 | chr5 | SAR1B | NM_001033503 | up |
| 868 | chr5 | TGFBI | NM_000358 | Down |
| 869 | chr5 | FAM13B | NM_016603 | Down |
| 870 | chr5 | FAM13B | NM_016603 | Down |
| 871 | chr5 | REEP2 | ENST00000254901 | Down |
| 872 | chr5 | ETF1 | NM_004730 | Down |
| 873 | chr5 | ETF1 | NM_004730 | Down |
| 874 | chr5 | CTNNA1 | NM_001903 | Down |
| 875 | chr5 | CTNNA1 | NM_001903 | Down |
| 876 | chr5 | SIL1 | NM_001037633 | up |
| 877 | chr5 | NRG2 | NM_004883 | Down |
| 878 | chr5 | SLC4A9 | NM_031467 | up |
| 879 | chr5 | PCDHB18 | NR_001281 | Down |
| 880 | chr5 | PCDHGA11 | NM_018914 | up |
| 881 | chr5 | FGF1 | NM_000800 | up |
| 882 | chr5 | PPP2R2B | NM_004576 | Down |
| 883 | chr5 | SPINK14 | NM_001001325 | up |
| 884 | chr5 | SH3TC2 | NM_024577 | Down |
| 885 | chr5 | ARHGEF37 | NM_001001669 | Down |
| 886 | chr5 | CAMK2A | NM_015981 | up |
| 887 | chr5 | CAMK2A | NM_015981 | up |
| 888 | chr5 | DCTN4 | NM_001135643 | up |
| 889 | chr5 | DCTN4 | NM_001135643 | Down |
| 890 | chr5 | ANXA6 | NM_001155 | up |
| 891 | chr5 | GRIA1 | NM_000827 | Down |
| 892 | chr5 | FAM114A2 | NM_018691 | Down |
| 893 | chr5 | MED7 | NM_001100816 | Down |
| 894 | chr5 | LSM11 | NM_173491 | up |
| 895 | chr5 | IL12B | NM_002187 | up |
| 896 | chr5 | IL12B | NM_002187 | Down |
| 897 | chr5 | CCNJL | NM_024565 | up |
| 898 | chr5 | GABRA1 | NM_000806 | up |
| 899 | chr5 | SLIT3 | NM_003062 | up |
| 900 | chr5 | SLIT3 | NM_003062 | up |
| 901 | chr5 | DOCK2 | NM_004946 | Down |

Fig. 2A-21

| | | | | |
|---|---|---|---|---|
| 902 | chr5 | LCP2 | NM_005565 | Down |
| 903 | chr5 | LCP2 | NM_005565 | Down |
| 904 | chr5 | KCNMB1 | BC025707 | up |
| 905 | chr5 | --- | --- | Down |
| 906 | chr5 | --- | --- | Down |
| 907 | chr5 | NKX2-5 | NM_004387 | Down |
| 908 | chr5 | HMP19 | NM_015980 | up |
| 909 | chr5 | NOP16 | NM_016391 | up |
| 910 | chr5 | CDHR2 | NM_001171976 | up |
| 911 | chr5 | HK3 | NM_002115 | Down |
| 912 | chr5 | ZNF346 | NM_012279 | up |
| 913 | chr5 | FGFR4 | NM_002011 | Down |
| 914 | chr5 | FGFR4 | NM_002011 | up |
| 915 | chr5 | NSD1 | NM_172349 | Down |
| 916 | chr5 | MXD3 | NM_031300 | Down |
| 917 | chr5 | B4GALT7 | NM_007255 | Down |
| 918 | chr5 | GRM6 | NM_000843 | Down |
| 919 | chr5 | ADAMTS2 | NM_014244 | up |
| 920 | chr5 | --- | --- | up |
| 921 | chr5 | RASGEF1C | ENST00000393371 | up |
| 922 | chr5 | GFPT2 | NM_005110 | up |
| 923 | chr5 | GFPT2 | NM_005110 | Down |
| 924 | chr5 | MGAT1 | NM_001114618 | Down |
| 925 | chr5 | BTNL3 | NM_197975 | Down |
| 926 | chr5 | TRIM52 | NM_032765 | up |
| 927 | chr6 | SERPINB9 | NM_004155 | Down |
| 928 | chr6 | PRPF4B | NM_003913 | Down |
| 929 | chr6 | RREB1 | NM_001168344 | Down |
| 930 | chr6 | CAGE1 | NM_001170692 | Down |
| 931 | chr6 | DSP | NM_004415 | Down |
| 932 | chr6 | GCNT2 | NM_145655 | Down |
| 933 | chr6 | ERVFRDE1 | NM_207582 | up |
| 934 | chr6 | TBC1D7 | NM_016495 | up |
| 935 | chr6 | NUP153 | NM_005124 | Down |
| 936 | chr6 | SOX4 | NM_003107 | Down |
| 937 | chr6 | SOX4 | NM_003107 | Down |
| 938 | chr6 | MRS2 | NM_020662 | up |
| 939 | chr6 | FAM65B | NM_014722 | Down |
| 940 | chr6 | LRRC16A | NM_017640 | up |
| 941 | chr6 | HIST1H1T | NM_005323 | Down |
| 942 | chr6 | BTN2A3 | ENST00000297020 | up |
| 943 | chr6 | ABT1 | NM_013375 | up |
| 944 | chr6 | HIST1H2AL | NM_003511 | Down |
| 945 | chr6 | OR2B6 | NM_012367 | up |

Fig. 2A-22

| | | | | |
|---|---|---|---|---|
| 946 | chr6 | GABBR1 | NM_001470 | up |
| 947 | chr6 | LOC554223 | BC051362 | Down |
| 948 | chr6 | TRIM39 | NM_021253 | up |
| 949 | chr6 | ---- | ---- | Down |
| 950 | chr6 | ---- | ---- | Down |
| 951 | chr6 | C6orf134 | NM_024909 | up |
| 952 | chr6 | DHX16 | NM_003587 | Down |
| 953 | chr6 | DHX16 | NM_003587 | Down |
| 954 | chr6 | DHX16 | NM_003587 | up |
| 955 | chr6 | MDC1 | NM_014641 | up |
| 956 | chr6 | FLOT1 | NM_005803 | Down |
| 957 | chr6 | CDSN | NM_001264 | Down |
| 958 | chr6 | ---- | ---- | Down |
| 959 | chr6 | LTA | NM_000595 | Down |
| 960 | chr6 | BAT2 | NM_080686 | Down |
| 961 | chr6 | C6orf26 | AJ245661 | up |
| 962 | chr6 | C6orf27 | NM_025258 | up |
| 963 | chr6 | C6orf27 | NM_025258 | Down |
| 964 | chr6 | C6orf27 | NM_025258 | up |
| 965 | chr6 | C6orf27 | NM_025258 | up |
| 966 | chr6 | C6orf27 | NM_025258 | Down |
| 967 | chr6 | VARS | NM_006295 | Down |
| 968 | chr6 | SLC44A4 | NM_025257 | Down |
| 969 | chr6 | EHMT2 | NM_006709 | up |
| 970 | chr6 | CFB | NM_001710 | Down |
| 971 | chr6 | CFB | NM_001710 | up |
| 972 | chr6 | C4A | NM_007293 | Down |
| 973 | chr6 | TNXB | NM_019105 | Down |
| 974 | chr6 | ATF6B | NM_004381 | Down |
| 975 | chr6 | PPT2 | NM_005155 | Down |
| 976 | chr6 | PPT2 | AF020544 | Down |
| 977 | chr6 | NOTCH4 | NM_004557 | up |
| 978 | chr6 | NOTCH4 | NM_004557 | up |
| 979 | chr6 | BTNL2 | NM_019602 | Down |
| 980 | chr6 | HLA-DPB1 | NM_002121 | up |
| 981 | chr6 | COL11A2 | NM_080680 | Down |
| 982 | chr6 | RXRB | NM_021976 | up |
| 983 | chr6 | VPS52 | NM_022553 | Down |
| 984 | chr6 | ITPR3 | NM_002224 | Down |
| 985 | chr6 | IP6K3 | NM_054111 | Down |
| 986 | chr6 | C6orf1 | NM_178508 | up |
| 987 | chr6 | NUDT3 | NM_006703 | up |
| 988 | chr6 | SPDEF | NM_012391 | Down |
| 989 | chr6 | SCUBE3 | NM_152753 | Down |

Fig. 2A-23

| | | | | |
|---|---|---|---|---|
| 990 | chr6 | DEF6 | NM_022047 | up |
| 991 | chr6 | LOC100131043 | AK124222 | up |
| 992 | chr6 | FGD2 | NM_173558 | Down |
| 993 | chr6 | RNF8 | NM_003958 | Down |
| 994 | chr6 | ZFAND3 | NM_021943 | Down |
| 995 | chr6 | GLP1R | NM_002062 | up |
| 996 | chr6 | C6orf64 | BC022007 | Down |
| 997 | chr6 | KCNK5 | NM_003740 | up |
| 998 | chr6 | DAAM2 | NM_015345 | Down |
| 999 | chr6 | TREML2 | NM_024807 | Down |
| 1000 | chr6 | TREML4 | NM_198153 | Down |
| 1001 | chr6 | TOMM6 | NM_001134493 | Down |
| 1002 | chr6 | CCND3 | NM_001760 | Down |
| 1003 | chr6 | TRERF1 | NM_033502 | up |
| 1004 | chr6 | PPP2R5D | NM_006245 | Down |
| 1005 | chr6 | CUL7 | NM_001168370 | Down |
| 1006 | chr6 | MRPL2 | NM_015950 | Down |
| 1007 | chr6 | CRIP3 | NM_206922 | Down |
| 1008 | chr6 | DLK2 | NM_023932 | Down |
| 1009 | chr6 | TJAP1 | NM_001146016 | Down |
| 1010 | chr6 | YIPF3 | NM_015388 | Down |
| 1011 | chr6 | POLH | NM_006502 | up |
| 1012 | chr6 | CAPN11 | NM_007058 | Down |
| 1013 | chr6 | HSP90AB1 | NM_007355 | Down |
| 1014 | chr6 | GPR116 | NM_015234 | up |
| 1015 | chr6 | TNFRSF21 | NM_014452 | up |
| 1016 | chr6 | TNFRSF21 | NM_014452 | up |
| 1017 | chr6 | OPN5 | NM_181744 | up |
| 1018 | chr6 | PKHD1 | NM_138694 | Down |
| 1019 | chr6 | LRRC1 | NM_018214 | Down |
| 1020 | chr6 | LRRC1 | NM_018214 | up |
| 1021 | chr6 | DST | ENST00000446842 | Down |
| 1022 | chr6 | COL19A1 | NM_001858 | Down |
| 1023 | chr6 | OGFRL1 | NM_024576 | up |
| 1024 | chr6 | KHDC1 | NM_030568 | Down |
| 1025 | chr6 | MYO6 | NM_004999 | Down |
| 1026 | chr6 | TPBG | NM_006670 | up |
| 1027 | chr6 | PNRC1 | NM_006813 | Down |
| 1028 | chr6 | CCNC | NM_005190 | up |
| 1029 | chr6 | SIM1 | NM_005068 | up |
| 1030 | chr6 | PREP | NM_002726 | Down |
| 1031 | chr6 | C6orf203 | NM_016487 | Down |
| 1032 | chr6 | ---- | ---- | Down |
| 1033 | chr6 | C6orf182 | NM_001083535 | Down |

Fig. 2A-24

| | | | | |
|---|---|---|---|---|
| 1034 | chr6 | AMD1 | NM_001634 | up |
| 1035 | chr6 | TRAF3IP2 | NR_028338 | Down |
| 1036 | chr6 | TSPYL4 | NM_021648 | Down |
| 1037 | chr6 | HINT3 | NM_138571 | Down |
| 1038 | chr6 | PTPRK | NM_001135648 | Down |
| 1039 | chr6 | LAMA2 | NM_000426 | Down |
| 1040 | chr6 | LAMA2 | NM_000426 | Down |
| 1041 | chr6 | MED23 | NM_004830 | up |
| 1042 | chr6 | SGK1 | NM_005627 | Down |
| 1043 | chr6 | AHI1 | NM_001134831 | up |
| 1044 | chr6 | TNFAIP3 | NM_006290 | up |
| 1045 | chr6 | NMBR | NM_002511 | up |
| 1046 | chr6 | VTA1 | NM_016485 | up |
| 1047 | chr6 | ADAT2 | NM_182503 | up |
| 1048 | chr6 | FUCA2 | NM_032020 | Down |
| 1049 | chr6 | EPM2A | NM_005670 | Down |
| 1050 | chr6 | SHPRH | NM_001042683 | up |
| 1051 | chr6 | SHPRH | NM_001042683 | up |
| 1052 | chr6 | STXBP5 | NM_139244 | Down |
| 1053 | chr6 | TAB2 | NM_015093 | Down |
| 1054 | chr6 | LRP11 | NM_032832 | up |
| 1055 | chr6 | PPP1R14C | NM_030949 | Down |
| 1056 | chr6 | IYD | NM_001164694 | up |
| 1057 | chr6 | MTHFD1L | NM_015440 | Down |
| 1058 | chr6 | SYNE1 | NM_182961 | up |
| 1059 | chr6 | OPRM1 | NM_000914 | Down |
| 1060 | chr6 | SNX9 | NM_016224 | up |
| 1061 | chr6 | SYNJ2 | NM_003898 | Down |
| 1062 | chr6 | EZR | NM_003379 | up |
| 1063 | chr6 | TAGAP | NM_152133 | Down |
| 1064 | chr6 | MRPL18 | NM_014161 | Down |
| 1065 | chr6 | IGF2R | NM_000876 | up |
| 1066 | chr6 | IGF2R | NM_000876 | up |
| 1067 | chr6 | MAP3K4 | NM_005922 | Down |
| 1068 | chr6 | PARK2 | NM_004562 | up |
| 1069 | chr6 | T | NM_003181 | up |
| 1070 | chr6 | RNASET2 | NM_003730 | Down |
| 1071 | chr6 | FGFR1OP | NM_007045 | Down |
| 1072 | chr6 | UNC93A | NM_018974 | up |
| 1073 | chr6 | KIF25 | NM_030615 | Down |
| 1074 | chr6 | FRMD1 | NM_024919 | up |
| 1075 | chr6 | SMOC2 | NM_022138 | up |
| 1076 | chr6 | THBS2 | NM_003247 | Down |
| 1077 | chr6 | WDR27 | NM_182552 | up |

Fig. 2A-25

| | | | | |
|---|---|---|---|---|
| 1078 | chr6 | C6orf208 | NR_026780 | up |
| 1079 | chr6 | DLL1 | NM_005618 | Down |
| 1080 | chr7 | ABCB8 | NM_007188 | up |
| 1081 | chr7 | CYP2W1 | NM_017781 | Down |
| 1082 | chr7 | CYP2W1 | NM_017781 | Down |
| 1083 | chr7 | GPER | NM_001039966 | up |
| 1084 | chr7 | GPER | NM_001505 | Down |
| 1085 | chr7 | MICALL2 | NM_182924 | up |
| 1086 | chr7 | MICALL2 | NM_182924 | up |
| 1087 | chr7 | INTS1 | NM_001080453 | up |
| 1088 | chr7 | INTS1 | NM_001080453 | Down |
| 1089 | chr7 | MAD1L1 | NM_003550 | up |
| 1090 | chr7 | NUDT1 | NM_002452 | Down |
| 1091 | chr7 | EIF3B | NM_003751 | Down |
| 1092 | chr7 | C7orf27 | NM_152743 | Down |
| 1093 | chr7 | C7orf27 | NM_152743 | Down |
| 1094 | chr7 | IQCE | NM_152558 | Down |
| 1095 | chr7 | TTYH3 | NM_025250 | Down |
| 1096 | chr7 | RNF216L | NR_023384 | Down |
| 1097 | chr7 | WIPI2 | NM_015610 | Down |
| 1098 | chr7 | FSCN1 | NM_003088 | Down |
| 1099 | chr7 | AIMP2 | NM_006303 | up |
| 1100 | chr7 | ICA1 | NM_004968 | Down |
| 1101 | chr7 | TMEM195 | NM_001004320 | Down |
| 1102 | chr7 | TMEM195 | NM_001004320 | Down |
| 1103 | chr7 | SP4 | NM_003112 | up |
| 1104 | chr7 | C7orf30 | AK127742 | up |
| 1105 | chr7 | OSBPL3 | NM_015550 | up |
| 1106 | chr7 | CYCS | NM_018947 | Down |
| 1107 | chr7 | HOXA1 | NM_005522 | up |
| 1108 | chr7 | CHN2 | NM_004067 | Down |
| 1109 | chr7 | CCDC129 | NM_194300 | up |
| 1110 | chr7 | FKBP9 | NM_007270 | Down |
| 1111 | chr7 | ELMO1 | NM_014800 | Down |
| 1112 | chr7 | ELMO1 | NM_014800 | Down |
| 1113 | chr7 | STARD3NL | NM_032016 | Down |
| 1114 | chr7 | POU6F2 | NM_007252 | up |
| 1115 | chr7 | GLI3 | NM_000168 | Down |
| 1116 | chr7 | POLM | BC026306 | Down |
| 1117 | chr7 | AEBP1 | NM_001129 | Down |
| 1118 | chr7 | POLD2 | NM_001127218 | Down |
| 1119 | chr7 | MYL7 | NM_021223 | Down |
| 1120 | chr7 | CAMK2B | NM_001220 | up |
| 1121 | chr7 | CAMK2B | NM_001220 | up |

Fig. 2A-26

| | | | | |
|---|---|---|---|---|
| 1122 | chr7 | NPC1L1 | NM_013389 | up |
| 1123 | chr7 | PPIA | NM_021130 | up |
| 1124 | chr7 | PURB | NM_033224 | up |
| 1125 | chr7 | CCM2 | NM_001029835 | Down |
| 1126 | chr7 | RAMP3 | NM_005856 | up |
| 1127 | chr7 | PKD1L1 | NM_138295 | Down |
| 1128 | chr7 | COBL | NM_015198 | Down |
| 1129 | chr7 | POM121L12 | NM_182595 | up |
| 1130 | chr7 | EGFR | NM_005228 | Down |
| 1131 | chr7 | EGFR | NM_005228 | Down |
| 1132 | chr7 | PSPH | NM_004577 | Down |
| 1133 | chr7 | NCRNA00174 | NR_026873 | Down |
| 1134 | chr7 | STAG3L4 | NM_022906 | Down |
| 1135 | chr7 | WBSCR17 | NM_022479 | up |
| 1136 | chr7 | WBSCR17 | NM_022479 | Down |
| 1137 | chr7 | CALN1 | NM_031468 | up |
| 1138 | chr7 | TBL2 | ENST00000437521 | Down |
| 1139 | chr7 | STX1A | NM_004603 | up |
| 1140 | chr7 | WBSCR28 | AY372054 | up |
| 1141 | chr7 | ELN | NM_000501 | Down |
| 1142 | chr7 | ELN | NM_000501 | Down |
| 1143 | chr7 | LAT2 | NM_032464 | Down |
| 1144 | chr7 | CLIP2 | NM_003388 | Down |
| 1145 | chr7 | HIP1 | NM_005338 | up |
| 1146 | chr7 | POR | NM_000941 | Down |
| 1147 | chr7 | YWHAG | NM_012479 | up |
| 1148 | chr7 | ZP3 | NM_001110354 | up |
| 1149 | chr7 | UPK3B | NM_030570 | up |
| 1150 | chr7 | MAGI2 | NM_012301 | Down |
| 1151 | chr7 | MAGI2 | NM_012301 | Down |
| 1152 | chr7 | CROT | NM_001143935 | Down |
| 1153 | chr7 | ADAM22 | NM_021723 | up |
| 1154 | chr7 | KRIT1 | NM_194456 | Down |
| 1155 | chr7 | CDK6 | NM_001259 | Down |
| 1156 | chr7 | CCDC132 | NM_017667 | Down |
| 1157 | chr7 | COL1A2 | NM_000089 | Down |
| 1158 | chr7 | SGCE | NM_001099401 | up |
| 1159 | chr7 | DYNC1I1 | NM_004411 | up |
| 1160 | chr7 | TECPR1 | NM_015395 | Down |
| 1161 | chr7 | BAIAP2L1 | NM_018842 | up |
| 1162 | chr7 | SMURF1 | NM_020429 | Down |
| 1163 | chr7 | ARPC1B | NM_005720 | Down |
| 1164 | chr7 | PDAP1 | NM_014891 | up |
| 1165 | chr7 | ZNF789 | NM_213603 | Down |

Fig. 2A-27

| | | | | |
|---|---|---|---|---|
| 1166 | chr7 | ZKSCAN1 | NM_003439 | Down |
| 1167 | chr7 | MCM7 | NM_005916 | up |
| 1168 | chr7 | C7orf43 | AK302342 | Down |
| 1169 | chr7 | GPC2 | NM_152742 | Down |
| 1170 | chr7 | GPC2 | NM_152742 | up |
| 1171 | chr7 | PILRA | NM_013439 | up |
| 1172 | chr7 | MEPCE | NM_019606 | Down |
| 1173 | chr7 | C7orf61 | BC031966 | Down |
| 1174 | chr7 | C7orf51 | AK124773 | up |
| 1175 | chr7 | LRCH4 | AK074175 | Down |
| 1176 | chr7 | LRCH4 | NM_002319 | Down |
| 1177 | chr7 | MOSPD3 | NM_023948 | up |
| 1178 | chr7 | GIGYF1 | NM_022574 | Down |
| 1179 | chr7 | ZAN | NM_003386 | Down |
| 1180 | chr7 | PLOD3 | NM_001084 | Down |
| 1181 | chr7 | PLOD3 | NM_001084 | up |
| 1182 | chr7 | ZNHIT1 | NM_006349 | up |
| 1183 | chr7 | MYL10 | NM_138403 | Down |
| 1184 | chr7 | CUX1 | NM_181552 | up |
| 1185 | chr7 | CUX1 | NM_181552 | Down |
| 1186 | chr7 | CUX1 | NM_001913 | Down |
| 1187 | chr7 | PRKRIP1 | NM_024653 | Down |
| 1188 | chr7 | RINT1 | NM_021930 | up |
| 1189 | chr7 | SYPL1 | NM_006754 | Down |
| 1190 | chr7 | FLJ36031 | NM_175884 | up |
| 1191 | chr7 | PRKAR2B | NM_002736 | up |
| 1192 | chr7 | PRKAR2B | NM_002736 | Down |
| 1193 | chr7 | TES | NM_015641 | Down |
| 1194 | chr7 | MET | NM_001127500 | up |
| 1195 | chr7 | WNT2 | NM_003391 | Down |
| 1196 | chr7 | CTTNBP2 | NM_033427 | Down |
| 1197 | chr7 | SLC13A1 | NM_022444 | up |
| 1198 | chr7 | GPR37 | NM_005302 | Down |
| 1199 | chr7 | POT1 | NM_015450 | up |
| 1200 | chr7 | FSCN3 | NM_020369 | Down |
| 1201 | chr7 | MGC27345 | ENST00000424840 | Down |
| 1202 | chr7 | CCDC136 | NM_022742 | Down |
| 1203 | chr7 | KCP | NM_001135914 | up |
| 1204 | chr7 | IRF5 | NM_032643 | up |
| 1205 | chr7 | TSPAN33 | NM_178562 | Down |
| 1206 | chr7 | SMO | NM_005631 | up |
| 1207 | chr7 | ZC3HC1 | NM_016478 | up |
| 1208 | chr7 | CPA2 | NM_001869 | Down |
| 1209 | chr7 | MKLN1 | NM_013255 | Down |

Fig. 2A-28

| | | | | |
|---|---|---|---|---|
| 1210 | chr7 | LRGUK | NM_144648 | Down |
| 1211 | chr7 | SLC35B4 | NM_032826 | Down |
| 1212 | chr7 | STRA8 | NM_182489 | Down |
| 1213 | chr7 | CNOT4 | NM_013316 | Down |
| 1214 | chr7 | CREB3L2 | NM_194071 | up |
| 1215 | chr7 | TRIM24 | NM_015905 | Down |
| 1216 | chr7 | KIAA1549 | NM_020910 | Down |
| 1217 | chr7 | ZC3HAV1 | NM_020119 | Down |
| 1218 | chr7 | TTC26 | NM_024926 | Down |
| 1219 | chr7 | LUC7L2 | NM_016019 | up |
| 1220 | chr7 | ADCK2 | NM_052853 | Down |
| 1221 | chr7 | NDUFB2 | NM_004546 | up |
| 1222 | chr7 | BRAF | NM_004333 | up |
| 1223 | chr7 | EPHB6 | NM_004445 | up |
| 1224 | chr7 | OR6W1P | NR_002140 | Down |
| 1225 | chr7 | CLCN1 | NM_000083 | Down |
| 1226 | chr7 | CUL1 | NM_003592 | up |
| 1227 | chr7 | EZH2 | NM_004456 | Down |
| 1228 | chr7 | PDIA4 | NM_004911 | Down |
| 1229 | chr7 | ZNF746 | NM_001163474 | Down |
| 1230 | chr7 | ZNF767 | NR_027788 | up |
| 1231 | chr7 | SSPO | NM_198455 | up |
| 1232 | chr7 | SSPO | AK124542 | up |
| 1233 | chr7 | REPIN1 | NM_013400 | Down |
| 1234 | chr7 | GIMAP8 | NM_175571 | Down |
| 1235 | chr7 | ATG9B | NM_173681 | Down |
| 1236 | chr7 | AGAP3 | NM_031946 | up |
| 1237 | chr7 | ABCF2 | NM_007189 | Down |
| 1238 | chr7 | MLL3 | NM_170606 | up |
| 1239 | chr7 | ACTR3B | NM_020445 | Down |
| 1240 | chr7 | DPP6 | NM_001936 | up |
| 1241 | chr7 | PAXIP1 | NM_007349 | up |
| 1242 | chr7 | NCAPG2 | NM_017760 | up |
| 1243 | chr8 | DLGAP2 | NM_004745 | up |
| 1244 | chr8 | DLGAP2 | NM_004745 | Down |
| 1245 | chr8 | ARHGEF10 | NM_014629 | Down |
| 1246 | chr8 | CSMD1 | NM_033225 | up |
| 1247 | chr8 | CSMD1 | NM_033225 | up |
| 1248 | chr8 | ERI1 | NM_153332 | Down |
| 1249 | chr8 | TNKS | NM_003747 | up |
| 1250 | chr8 | RP1L1 | NM_178857 | up |
| 1251 | chr8 | FAM167A | NM_053279 | up |
| 1252 | chr8 | NSAP11 | AY176665 | Down |
| 1253 | chr8 | FGF17 | NM_003867 | Down |

Fig. 2A-29

| | | | | |
|---|---|---|---|---|
| 1254 | chr8 | FAM160B2 | NM_022749 | Down |
| 1255 | chr8 | BMP1 | NM_001199 | Down |
| 1256 | chr8 | PDLIM2 | NM_021630 | Down |
| 1257 | chr8 | KIAA1967 | NM_021174 | Down |
| 1258 | chr8 | KIAA1967 | NM_021174 | Down |
| 1259 | chr8 | RHOBTB2 | NM_001160036 | Down |
| 1260 | chr8 | RHOBTB2 | NM_001160036 | up |
| 1261 | chr8 | TNFRSF10B | NM_003842 | Down |
| 1262 | chr8 | TNFRSF10D | NM_003840 | Down |
| 1263 | chr8 | CHMP7 | NM_152272 | Down |
| 1264 | chr8 | LOXL2 | NM_002318 | Down |
| 1265 | chr8 | SLC25A37 | NM_016612 | up |
| 1266 | chr8 | NEFL | NM_006158 | Down |
| 1267 | chr8 | DOCK5 | NM_024940 | Down |
| 1268 | chr8 | BNIP3L | NM_004331 | up |
| 1269 | chr8 | DPYSL2 | NM_001386 | Down |
| 1270 | chr8 | CLU | NM_001831 | Down |
| 1271 | chr8 | PBK | NM_018492 | up |
| 1272 | chr8 | ELP3 | NM_018091 | Down |
| 1273 | chr8 | PNOC | NM_006228 | Down |
| 1274 | chr8 | KIF13B | NM_015254 | up |
| 1275 | chr8 | PURG | NM_013357 | up |
| 1276 | chr8 | GPR124 | NM_032777 | Down |
| 1277 | chr8 | GPR124 | NM_032777 | up |
| 1278 | chr8 | PPAPDC1B | NM_001102559 | Down |
| 1279 | chr8 | WHSC1L1 | NM_023034 | up |
| 1280 | chr8 | TM2D2 | NM_031940 | up |
| 1281 | chr8 | C8orf4 | NM_020130 | Down |
| 1282 | chr8 | ANK1 | NM_020476 | Down |
| 1283 | chr8 | IKBKB | NM_001556 | up |
| 1284 | chr8 | VDAC3 | NM_001135694 | up |
| 1285 | chr8 | THAP1 | NM_018105 | up |
| 1286 | chr8 | SGK196 | NM_032237 | Down |
| 1287 | chr8 | EFCAB1 | NR_024605 | up |
| 1288 | chr8 | TOX | NM_014729 | Down |
| 1289 | chr8 | ADHFE1 | NM_144650 | Down |
| 1290 | chr8 | ADHFE1 | NM_144650 | Down |
| 1291 | chr8 | STAU2 | NM_001164380 | up |
| 1292 | chr8 | ZFHX4 | NM_024721 | up |
| 1293 | chr8 | TMEM55A | NM_018710 | Down |
| 1294 | chr8 | RUNX1T1 | NM_175634 | up |
| 1295 | chr8 | PTDSS1 | NM_014754 | Down |
| 1296 | chr8 | ---- | ---- | Down |
| 1297 | chr8 | C8orf47 | NM_173549 | up |

Fig. 2A-30

| | | | | |
|---|---|---|---|---|
| 1298 | chr8 | POP1 | NM_001145860 | up |
| 1299 | chr8 | NIPAL2 | NM_024759 | Down |
| 1300 | chr8 | VPS13B | NM_152564 | Down |
| 1301 | chr8 | GRHL2 | NM_024915 | Down |
| 1302 | chr8 | UBR5 | NM_015902 | Down |
| 1303 | chr8 | KLF10 | NM_005655 | up |
| 1304 | chr8 | SLC25A32 | NM_030780 | up |
| 1305 | chr8 | RIMS2 | NM_001100117 | Down |
| 1306 | chr8 | OXR1 | NM_181354 | up |
| 1307 | chr8 | EBAG9 | NM_004215 | up |
| 1308 | chr8 | KCNV1 | NM_014379 | up |
| 1309 | chr8 | EXT1 | NM_000127 | Down |
| 1310 | chr8 | MTBP | NM_022045 | up |
| 1311 | chr8 | FBXO32 | NM_058229 | Down |
| 1312 | chr8 | RNF139 | NM_007218 | up |
| 1313 | chr8 | KIAA0196 | NM_014846 | Down |
| 1314 | chr8 | FAM49B | BC016345 | Down |
| 1315 | chr8 | ADCY8 | NM_001115 | up |
| 1316 | chr8 | PHF20L1 | NM_016018 | Down |
| 1317 | chr8 | TG | NM_003235 | Down |
| 1318 | chr8 | COL22A1 | NM_152888 | Down |
| 1319 | chr8 | COL22A1 | NM_152888 | up |
| 1320 | chr8 | DENND3 | NM_014957 | Down |
| 1321 | chr8 | ZNF696 | NM_030895 | Down |
| 1322 | chr8 | TOP1MT | NM_052963 | Down |
| 1323 | chr8 | RHPN1 | NM_052924 | up |
| 1324 | chr8 | FAM83H | NM_198488 | Down |
| 1325 | chr8 | SCRIB | NM_182706 | up |
| 1326 | chr8 | NRBP2 | NM_178564 | up |
| 1327 | chr8 | PARP10 | NM_032789 | up |
| 1328 | chr8 | PARP10 | NM_032789 | up |
| 1329 | chr8 | SPATC1 | NM_198572 | up |
| 1330 | chr8 | OPLAH | NM_017570 | up |
| 1331 | chr8 | OPLAH | NM_017570 | up |
| 1332 | chr8 | ADCK5 | NM_174922 | Down |
| 1333 | chr8 | SLC39A4 | NM_017767 | Down |
| 1334 | chr8 | VPS28 | AK091979 | Down |
| 1335 | chr8 | FOXH1 | NM_003923 | Down |
| 1336 | chr9 | DOCK8 | NM_203447 | up |
| 1337 | chr9 | SMARCA2 | NM_003070 | Down |
| 1338 | chr9 | JAK2 | NM_004972 | up |
| 1339 | chr9 | PTPRD | NM_002839 | up |
| 1340 | chr9 | FREM1 | NM_001177704 | Down |
| 1341 | chr9 | PSIP1 | NM_021144 | Down |

Fig. 2A-31

| | | | | |
|---|---|---|---|---|
| 1342 | chr9 | ADAMTSL1 | NM_001040272 | up |
| 1343 | chr9 | ADAMTSL1 | NM_001040272 | up |
| 1344 | chr9 | RRAGA | NM_006570 | Down |
| 1345 | chr9 | TMEM215 | NM_212558 | up |
| 1346 | chr9 | NOL6 | NM_022917 | Down |
| 1347 | chr9 | ENHO | NM_198573 | Down |
| 1348 | chr9 | C9orf23 | NM_148178 | Down |
| 1349 | chr9 | SIGMAR1 | NM_005866 | Down |
| 1350 | chr9 | FANCG | NM_004629 | up |
| 1351 | chr9 | KIAA1539 | BC004406 | Down |
| 1352 | chr9 | UNC13B | NM_006377 | Down |
| 1353 | chr9 | CD72 | NM_001782 | Down |
| 1354 | chr9 | C9orf100 | NM_032818 | Down |
| 1355 | chr9 | CA9 | NM_001216 | up |
| 1356 | chr9 | RGP1 | NM_001080496 | Down |
| 1357 | chr9 | OR2S2 | NM_019897 | up |
| 1358 | chr9 | GRHPR | NM_012203 | up |
| 1359 | chr9 | ANKRD18A | AK093059 | Down |
| 1360 | chr9 | TJP2 | NM_004817 | Down |
| 1361 | chr9 | MAMDC2 | NM_153267 | up |
| 1362 | chr9 | C9orf41 | AK299691 | up |
| 1363 | chr9 | GCNT1 | NM_001097634 | up |
| 1364 | chr9 | PRUNE2 | NM_015225 | Down |
| 1365 | chr9 | FLJ46321 | NM_001001670 | up |
| 1366 | chr9 | --- | --- | up |
| 1367 | chr9 | CTSL1 | NM_001912 | Down |
| 1368 | chr9 | CDK20 | NM_178432 | Down |
| 1369 | chr9 | SPIN1 | NM_006717 | Down |
| 1370 | chr9 | SHC3 | NM_016848 | Down |
| 1371 | chr9 | SHC3 | NM_016848 | up |
| 1372 | chr9 | AUH | NM_001698 | Down |
| 1373 | chr9 | NOL8 | NR_024020 | up |
| 1374 | chr9 | NOL8 | NR_024020 | Down |
| 1375 | chr9 | ECM2 | NM_001393 | up |
| 1376 | chr9 | C9orf89 | AK128259 | up |
| 1377 | chr9 | BARX1 | NM_021570 | Down |
| 1378 | chr9 | FBP2 | NM_003837 | Down |
| 1379 | chr9 | HSD17B3 | NM_000197 | Down |
| 1380 | chr9 | TDRD7 | NM_014290 | Down |
| 1381 | chr9 | TMOD1 | NM_003275 | Down |
| 1382 | chr9 | FOXE1 | NM_004473 | up |
| 1383 | chr9 | NANS | NM_018946 | Down |
| 1384 | chr9 | TBC1D2 | NM_018421 | Down |
| 1385 | chr9 | COL15A1 | NM_001855 | Down |

Fig. 2A-32

| | | | | |
|---|---|---|---|---|
| 1386 | chr9 | TGFBR1 | NM_004612 | Down |
| 1387 | chr9 | STX17 | NM_017919 | Down |
| 1388 | chr9 | C9orf5 | NM_032012 | up |
| 1389 | chr9 | PTPN3 | NM_002829 | up |
| 1390 | chr9 | PTPN3 | NM_002829 | Down |
| 1391 | chr9 | AKAP2 | NM_001004065 | up |
| 1392 | chr9 | ZNF483 | NM_133464 | Down |
| 1393 | chr9 | DNAJC25-GNG10 | NM_004125 | up |
| 1394 | chr9 | SUSD1 | NM_022486 | up |
| 1395 | chr9 | SLC46A2 | NM_033051 | Down |
| 1396 | chr9 | RNF183 | NM_145051 | Down |
| 1397 | chr9 | RGS3 | NM_130795 | Down |
| 1398 | chr9 | FLJ31713 | AK056275 | Down |
| 1399 | chr9 | COL27A1 | NM_032888 | up |
| 1400 | chr9 | COL27A1 | NM_032888 | up |
| 1401 | chr9 | AKNA | NM_030767 | Down |
| 1402 | chr9 | TNC | NM_002160 | Down |
| 1403 | chr9 | TNC | NM_002160 | Down |
| 1404 | chr9 | TLR4 | NM_138554 | up |
| 1405 | chr9 | CDK5RAP2 | NM_018249 | Down |
| 1406 | chr9 | ARPC5L | NM_030978 | Down |
| 1407 | chr9 | SCAI | NM_173690 | up |
| 1408 | chr9 | RABEPK | NM_005833 | Down |
| 1409 | chr9 | GARNL3 | NM_032293 | Down |
| 1410 | chr9 | GARNL3 | NM_032293 | up |
| 1411 | chr9 | LRSAM1 | NM_001005373 | up |
| 1412 | chr9 | ENG | NM_001114753 | Down |
| 1413 | chr9 | PTGES2 | NM_025072 | Down |
| 1414 | chr9 | LCN2 | NM_005564 | Down |
| 1415 | chr9 | CIZ1 | NM_012127 | up |
| 1416 | chr9 | SLC27A4 | NM_005094 | up |
| 1417 | chr9 | URM1 | NM_030914 | up |
| 1418 | chr9 | ODF2 | NM_002540 | Down |
| 1419 | chr9 | GLE1 | NM_001003722 | Down |
| 1420 | chr9 | SPTAN1 | NM_001130438 | Down |
| 1421 | chr9 | FAM73B | AK301241 | Down |
| 1422 | chr9 | TOR1B | NM_014506 | Down |
| 1423 | chr9 | USP20 | NM_006676 | Down |
| 1424 | chr9 | USP20 | NM_006676 | Down |
| 1425 | chr9 | USP20 | NM_006676 | up |
| 1426 | chr9 | NCS1 | NM_014286 | up |
| 1427 | chr9 | LAMC3 | NM_006059 | up |
| 1428 | chr9 | LAMC3 | NM_006059 | up |
| 1429 | chr9 | AIF1L | NM_031426 | up |

Fig. 2A-33

| | | | | |
|---|---|---|---|---|
| 1430 | chr9 | NUP214 | NM_005085 | Down |
| 1431 | chr9 | FAM78A | NM_033387 | up |
| 1432 | chr9 | POMT1 | NM_007171 | Down |
| 1433 | chr9 | UCK1 | NM_031432 | up |
| 1434 | chr9 | BARHL1 | NM_020064 | Down |
| 1435 | chr9 | TSC1 | NM_000368 | up |
| 1436 | chr9 | VAV2 | NM_001134398 | Down |
| 1437 | chr9 | COL5A1 | NM_000093 | Down |
| 1438 | chr9 | OLFM1 | NM_014279 | Down |
| 1439 | chr9 | OLFM1 | BC000189 | Down |
| 1440 | chr9 | KIAA0649 | NM_014811 | up |
| 1441 | chr9 | GLT6D1 | NM_182974 | up |
| 1442 | chr9 | CAMSAP1 | NM_015447 | Down |
| 1443 | chr9 | SDCCAG3 | NM_001039707 | up |
| 1444 | chr9 | NOTCH1 | NM_017617 | Down |
| 1445 | chr9 | EGFL7 | NM_016215 | Down |
| 1446 | chr9 | KIAA1984 | BC007542 | up |
| 1447 | chr9 | C9orf86 | NM_024718 | Down |
| 1448 | chr9 | TRAF2 | NM_021138 | up |
| 1449 | chr9 | FBXW5 | NM_018998 | up |
| 1450 | chr9 | LCNL1 | NM_207510 | up |
| 1451 | chr9 | LCNL1 | NM_207510 | up |
| 1452 | chr9 | ABCA2 | NM_001606 | Down |
| 1453 | chr9 | C9orf139 | BC132809 | up |
| 1454 | chr9 | C9orf140 | NM_178448 | up |
| 1455 | chr9 | UAP1L1 | NM_207309 | Down |
| 1456 | chr9 | NOXA1 | NM_006647 | up |
| 1457 | chr9 | ENTPD8 | NM_001033113 | Down |
| 1458 | chr9 | CACNA1B | NM_000718 | Down |
| 1459 | chrX | GPR143 | NM_000273 | Down |
| 1460 | chrX | SHROOM2 | NM_001649 | Down |
| 1461 | chrX | CLCN4 | NM_001830 | up |
| 1462 | chrX | AMELX | NM_001142 | up |
| 1463 | chrX | ARHGAP6 | NM_013427 | Down |
| 1464 | chrX | PRPS2 | NM_001039091 | Down |
| 1465 | chrX | PRPS2 | NM_001039091 | up |
| 1466 | chrX | GRPR | NM_005314 | up |
| 1467 | chrX | CTPS2 | AF226667 | up |
| 1468 | chrX | CTPS2 | AF226667 | up |
| 1469 | chrX | SYAP1 | NR_033181 | Down |
| 1470 | chrX | PPEF1 | NM_006240 | up |
| 1471 | chrX | PHKA2 | NM_000292 | Down |
| 1472 | chrX | KLHL34 | NM_153270 | up |
| 1473 | chrX | PHEX | NM_000444 | up |

Fig. 2A-34

| | | | | |
|---|---|---|---|---|
| 1474 | chrX | IL1RAPL1 | NM_014271 | Down |
| 1475 | chrX | TAB3 | NM_152787 | up |
| 1476 | chrX | BCOR | NM_017745 | up |
| 1477 | chrX | MED14 | NM_004229 | Down |
| 1478 | chrX | USP9X | NM_001039590 | Down |
| 1479 | chrX | USP11 | NM_004651 | Down |
| 1480 | chrX | ZNF41 | NM_007130 | Down |
| 1481 | chrX | ZNF41 | NM_007130 | Down |
| 1482 | chrX | ARAF | NM_001654 | up |
| 1483 | chrX | PORCN | NM_022825 | Down |
| 1484 | chrX | WAS | NM_000377 | Down |
| 1485 | chrX | WAS | NM_000377 | up |
| 1486 | chrX | PQBP1 | NM_001032382 | up |
| 1487 | chrX | SLC35A2 | NM_001032289 | Down |
| 1488 | chrX | GPKOW | U66359 | Down |
| 1489 | chrX | MAGIX | NM_024859 | Down |
| 1490 | chrX | PRICKLE3 | NM_006150 | Down |
| 1491 | chrX | CACNA1F | NM_005183 | Down |
| 1492 | chrX | CCDC22 | NM_014008 | up |
| 1493 | chrX | CCDC22 | NM_014008 | up |
| 1494 | chrX | FOXP3 | NM_014009 | Down |
| 1495 | chrX | AKAP4 | NM_003886 | Down |
| 1496 | chrX | KDM5C | NM_004187 | Down |
| 1497 | chrX | FGD1 | NM_004463 | up |
| 1498 | chrX | FGD1 | NM_004463 | Down |
| 1499 | chrX | LAS1L | NM_031206 | Down |
| 1500 | chrX | VSIG4 | NM_007268 | up |
| 1501 | chrX | VSIG4 | NM_007268 | up |
| 1502 | chrX | AR | NM_000044 | Down |
| 1503 | chrX | AR | NM_000044 | up |
| 1504 | chrX | NLGN3 | NM_181303 | Down |
| 1505 | chrX | TAF1 | NM_004606 | Down |
| 1506 | chrX | HDAC8 | NM_018486 | up |
| 1507 | chrX | CDX4 | NM_005193 | Down |
| 1508 | chrX | MAGT1 | NM_032121 | Down |
| 1509 | chrX | SH3BGRL | NM_003022 | up |
| 1510 | chrX | SRPX2 | NM_014467 | Down |
| 1511 | chrX | ARMCX1 | NM_016608 | Down |
| 1512 | chrX | ARMCX2 | NM_014782 | up |
| 1513 | chrX | NXF4 | NR_002216 | up |
| 1514 | chrX | ESX1 | NM_153448 | up |
| 1515 | chrX | MORC4 | NM_024657 | up |
| 1516 | chrX | TEX13B | NM_031273 | up |
| 1517 | chrX | VSIG1 | NM_001170553 | up |

Fig. 2A-35

| | | | | |
|---|---|---|---|---|
| 1518 | chrX | COL4A6 | NM_001847 | up |
| 1519 | chrX | COL4A6 | NM_001847 | Down |
| 1520 | chrX | KCNE1L | NM_012282 | Down |
| 1521 | chrX | ZCCHC16 | NM_001004308 | up |
| 1522 | chrX | AMOT | NM_133265 | Down |
| 1523 | chrX | LRCH2 | NM_020871 | up |
| 1524 | chrX | IL13RA1 | NM_001560 | Down |
| 1525 | chrX | PGRMC1 | NM_006667 | up |
| 1526 | chrX | SLC25A43 | NM_145305 | Down |
| 1527 | chrX | RNF113A | NM_006978 | up |
| 1528 | chrX | GRIA3 | NM_007325 | up |
| 1529 | chrX | XPNPEP2 | NM_003399 | Down |
| 1530 | chrX | AIFM1 | NM_004208 | Down |
| 1531 | chrX | SLC25A14 | NM_003951 | up |
| 1532 | chrX | MST4 | NM_016542 | up |
| 1533 | chrX | MBNL3 | NM_018388 | Down |
| 1534 | chrX | HS6ST2 | NM_001077188 | up |
| 1535 | chrX | NCRNA00086 | NR_024359 | Down |
| 1536 | chrX | MCF2 | NM_005369 | Down |
| 1537 | chrX | AFF2 | NM_002025 | up |
| 1538 | chrX | CXorf40A | NM_178124 | Down |
| 1539 | chrX | HMGB3 | NM_005342 | up |
| 1540 | chrX | MAGEA10 | NM_001011543 | up |
| 1541 | chrX | DUSP9 | NM_001395 | up |
| 1542 | chrX | PLXNB3 | NM_005393 | Down |
| 1543 | chrX | PLXNB3 | NM_005393 | up |
| 1544 | chrX | PLXNB3 | NM_005393 | Down |
| 1545 | chrX | PLXNB3 | NM_005393 | up |
| 1546 | chrX | SRPK3 | NM_014370 | Down |
| 1547 | chrX | HCFC1 | NM_005334 | Down |
| 1548 | chrX | MECP2 | NM_004992 | Down |
| 1549 | chrX | FLNA | NM_001456 | Down |
| 1550 | chrX | FLNA | NM_001456 | Down |
| 1551 | chrX | ATP6AP1 | NM_001183 | Down |
| 1552 | chrX | PLXNA3 | NM_017514 | Down |
| 1553 | chrX | CTAG2 | AJ223040 | up |
| 1554 | chrX | GAB3 | NM_001081573 | up |
| 1555 | chrX | CLIC2 | NM_001289 | Down |
| 1556 | chrY | PRKY | NR_028062 | Down |
| 1557 | chrY | --- | --- | up |
| 1558 | chr10 | ZMYND11 | NM_006624 | Down |
| 1559 | chr10 | DIP2C | NM_014974 | Down |
| 1560 | chr10 | WDR37 | NM_014023 | Down |
| 1561 | chr10 | PFKP | NM_002627 | Down |

Fig. 2A-36

| | | | | |
|---|---|---|---|---|
| 1562 | chr10 | PFKP | NM_002627 | Down |
| 1563 | chr10 | --- | ---- | Down |
| 1564 | chr10 | --- | ---- | Down |
| 1565 | chr10 | IL15RA | NM_002189 | up |
| 1566 | chr10 | FLJ45983 | NR_024255 | Down |
| 1567 | chr10 | C10orf47 | NM_153256 | Down |
| 1568 | chr10 | BEND7 | NM_152751 | up |
| 1569 | chr10 | BEND7 | NM_152751 | Down |
| 1570 | chr10 | HSPA14 | NM_016299 | Down |
| 1571 | chr10 | HSPA14 | NM_016299 | up |
| 1572 | chr10 | RSU1 | ENST00000377921 | Down |
| 1573 | chr10 | CUBN | NM_001081 | up |
| 1574 | chr10 | STAM | NM_003473 | Down |
| 1575 | chr10 | CACNB2 | NM_201590 | Down |
| 1576 | chr10 | PLXDC2 | NM_032812 | Down |
| 1577 | chr10 | KIAA1217 | NM_019590 | up |
| 1578 | chr10 | YME1L1 | NM_139312 | Down |
| 1579 | chr10 | ARMC4 | NM_018076 | Down |
| 1580 | chr10 | EPC1 | NM_025209 | Down |
| 1581 | chr10 | PARD3 | NM_019619 | up |
| 1582 | chr10 | CCNY | NM_181698 | Down |
| 1583 | chr10 | ZNF248 | NM_021045 | up |
| 1584 | chr10 | RET | NM_020975 | Down |
| 1585 | chr10 | HNRNPF | NM_001098208 | Down |
| 1586 | chr10 | LOC439911 | AK127450 | up |
| 1587 | chr10 | ZNF485 | NM_145312 | Down |
| 1588 | chr10 | C10orf10 | NM_007021 | up |
| 1589 | chr10 | ALOX5 | NM_000698 | Down |
| 1590 | chr10 | WDFY4 | NM_020945 | Down |
| 1591 | chr10 | FAM13C | NM_198215 | up |
| 1592 | chr10 | ZNF365 | NM_014951 | Down |
| 1593 | chr10 | SIRT1 | NM_012238 | up |
| 1594 | chr10 | MYPN | NM_032578 | up |
| 1595 | chr10 | SRGN | NM_002727 | Down |
| 1596 | chr10 | HK1 | NM_033496 | Down |
| 1597 | chr10 | C10orf35 | NM_145306 | Down |
| 1598 | chr10 | TYSND1 | NM_173555 | Down |
| 1599 | chr10 | TYSND1 | NM_173555 | up |
| 1600 | chr10 | NPFFR1 | NM_022146 | Down |
| 1601 | chr10 | ADAMTS14 | NM_139155 | Down |
| 1602 | chr10 | CDH23 | NM_022124 | up |
| 1603 | chr10 | ASCC1 | NM_015947 | Down |
| 1604 | chr10 | OIT3 | NM_152635 | Down |
| 1605 | chr10 | TTC18 | NM_145170 | Down |

Fig. 2A-37

| | | | | |
|---|---|---|---|---|
| 1606 | chr10 | SYNPO2L | NM_001114133 | up |
| 1607 | chr10 | CAMK2G | NM_172171 | Down |
| 1608 | chr10 | ZMIZ1 | NM_020338 | up |
| 1609 | chr10 | MAT1A | NM_000429 | up |
| 1610 | chr10 | TSPAN14 | NM_030927 | up |
| 1611 | chr10 | CDHR1 | NM_001171971 | Down |
| 1612 | chr10 | RGR | NM_002921 | up |
| 1613 | chr10 | GRID1 | NM_017551 | Down |
| 1614 | chr10 | LDB3 | NM_007078 | up |
| 1615 | chr10 | MMRN2 | NM_024756 | Down |
| 1616 | chr10 | CFLP1 | NR_028492 | Down |
| 1617 | chr10 | PTEN | NM_000314 | up |
| 1618 | chr10 | SLC16A12 | NM_213606 | Down |
| 1619 | chr10 | FGFBP3 | NM_152429 | up |
| 1620 | chr10 | PLCE1 | NM_016341 | up |
| 1621 | chr10 | SORBS1 | NM_001034954 | up |
| 1622 | chr10 | SORBS1 | NM_006434 | Down |
| 1623 | chr10 | BLNK | NM_013314 | Down |
| 1624 | chr10 | DNTT | NM_004088 | Down |
| 1625 | chr10 | TLL2 | NM_012465 | Down |
| 1626 | chr10 | TLL2 | NM_012465 | Down |
| 1627 | chr10 | FRAT2 | NM_012083 | up |
| 1628 | chr10 | MMS19 | NM_022362 | Down |
| 1629 | chr10 | HPS1 | NM_000195 | Down |
| 1630 | chr10 | GOT1 | NM_002079 | Down |
| 1631 | chr10 | NKX2-3 | NM_145285 | Down |
| 1632 | chr10 | ENTPD7 | NM_020354 | Down |
| 1633 | chr10 | COX15 | NM_078470 | Down |
| 1634 | chr10 | PKD2L1 | NM_016112 | up |
| 1635 | chr10 | FAM178A | NM_018121 | up |
| 1636 | chr10 | LZTS2 | NM_032429 | Down |
| 1637 | chr10 | PDZD7 | NM_024895 | Down |
| 1638 | chr10 | BTRC | NM_033637 | Down |
| 1639 | chr10 | POLL | NM_001174084 | up |
| 1640 | chr10 | FBXW4 | NM_022039 | up |
| 1641 | chr10 | KCNIP2 | NM_014591 | Down |
| 1642 | chr10 | INA | NM_032727 | up |
| 1643 | chr10 | TAF5 | NM_006951 | up |
| 1644 | chr10 | CALHM1 | NM_001001412 | up |
| 1645 | chr10 | SH3PXD2A | NM_014631 | Down |
| 1646 | chr10 | OBFC1 | NM_024928 | up |
| 1647 | chr10 | C10orf79 | NM_025145 | Down |
| 1648 | chr10 | GSTO2 | NM_183239 | Down |
| 1649 | chr10 | DUSP5 | NM_004419 | up |

Fig. 2A-38

| | | | | |
|---|---|---|---|---|
| 1650 | chr10 | ADRA2A | NM_000681 | Down |
| 1651 | chr10 | TCF7L2 | NM_001146274 | Down |
| 1652 | chr10 | NRAP | NM_006175 | Down |
| 1653 | chr10 | ADRB1 | NM_000684 | up |
| 1654 | chr10 | TDRD1 | NM_198795 | up |
| 1655 | chr10 | FAM160B1 | NM_001135051 | up |
| 1656 | chr10 | ATRNL1 | NM_207303 | up |
| 1657 | chr10 | GFRA1 | NM_005264 | up |
| 1658 | chr10 | PNLIPRP2 | NM_005396 | Down |
| 1659 | chr10 | RAB11FIP2 | NM_014904 | Down |
| 1660 | chr10 | EIF3A | NM_003750 | Down |
| 1661 | chr10 | GRK5 | NM_005308 | Down |
| 1662 | chr10 | INPP5F | NM_014937 | Down |
| 1663 | chr10 | SEC23IP | NM_007190 | Down |
| 1664 | chr10 | TACC2 | NM_206862 | up |
| 1665 | chr10 | FLJ46361 | NR_003570 | up |
| 1666 | chr10 | PSTK | NM_153336 | Down |
| 1667 | chr10 | PSTK | NM_153336 | Down |
| 1668 | chr10 | METTL10 | NM_212554 | Down |
| 1669 | chr10 | CTBP2 | NM_022802 | up |
| 1670 | chr10 | DPYSL4 | NM_006426 | Down |
| 1671 | chr10 | C10orf93 | NM_173572 | Down |
| 1672 | chr10 | KNDC1 | NM_152643 | Down |
| 1673 | chr10 | KNDC1 | NM_152643 | up |
| 1674 | chr10 | KNDC1 | NM_152643 | up |
| 1675 | chr10 | VENTX | NM_014468 | Down |
| 1676 | chr10 | ADAM8 | NM_001109 | up |
| 1677 | chr10 | ZNF511 | NM_145806 | Down |
| 1678 | chr10 | C10orf125 | NM_001098483 | Down |
| 1679 | chr10 | ECHS1 | NM_004092 | Down |
| 1680 | chr10 | PAOX | NM_152911 | Down |
| 1681 | chr11 | B4GALNT4 | NM_178537 | Down |
| 1682 | chr11 | PKP3 | NM_007183 | up |
| 1683 | chr11 | PKP3 | NM_007183 | up |
| 1684 | chr11 | PKP3 | NM_007183 | Down |
| 1685 | chr11 | SIGIRR | NM_001135054 | Down |
| 1686 | chr11 | LRRC56 | NM_198075 | Down |
| 1687 | chr11 | C11orf35 | NM_173573 | up |
| 1688 | chr11 | IRF7 | NM_001572 | Down |
| 1689 | chr11 | CDHR5 | NM_021924 | Down |
| 1690 | chr11 | CDHR5 | NM_021924 | Down |
| 1691 | chr11 | SCT | NM_021920 | Down |
| 1692 | chr11 | EPS8L2 | NM_022772 | Down |
| 1693 | chr11 | EPS8L2 | NM_022772 | up |

Fig. 2A-39

| | | | | |
|---|---|---|---|---|
| 1694 | chr11 | LRDD | NM_145886 | up |
| 1695 | chr11 | LRDD | NM_145886 | up |
| 1696 | chr11 | KCNQ1 | NM_000218 | Down |
| 1697 | chr11 | SLC22A18 | NM_002555 | Down |
| 1698 | chr11 | SLC22A18 | NM_002555 | up |
| 1699 | chr11 | OR52A4 | NM_001005222 | up |
| 1700 | chr11 | HBE1 | NM_005330 | up |
| 1701 | chr11 | OR52B6 | NM_001005162 | Down |
| 1702 | chr11 | FAM160A2 | NM_032127 | Down |
| 1703 | chr11 | APBB1 | NM_001164 | Down |
| 1704 | chr11 | CYB5R2 | NM_016229 | Down |
| 1705 | chr11 | RPL27A | NM_000990 | Down |
| 1706 | chr11 | AMPD3 | NM_000480 | Down |
| 1707 | chr11 | MICALCL | NM_032867 | Down |
| 1708 | chr11 | MICALCL | NM_032867 | Down |
| 1709 | chr11 | PDE3B | NM_000922 | up |
| 1710 | chr11 | PDE3B | NM_000922 | Down |
| 1711 | chr11 | SOX6 | NM_017508 | Down |
| 1712 | chr11 | RPS13 | NM_001017 | up |
| 1713 | chr11 | MYOD1 | NM_002478 | up |
| 1714 | chr11 | --- | --- | Down |
| 1715 | chr11 | GTF2H1 | NM_005316 | Down |
| 1716 | chr11 | UEVLD | NM_001040697 | up |
| 1717 | chr11 | SPTY2D1 | NM_194285 | up |
| 1718 | chr11 | NAV2 | NM_182964 | up |
| 1719 | chr11 | NAV2 | NM_182964 | up |
| 1720 | chr11 | LUZP2 | NM_001009909 | Down |
| 1721 | chr11 | KCNA4 | NM_002233 | up |
| 1722 | chr11 | PRRG4 | NM_024081 | Down |
| 1723 | chr11 | PRRG4 | NM_024081 | up |
| 1724 | chr11 | SLC1A2 | ENST00000395750 | Down |
| 1725 | chr11 | PRR5L | NM_024841 | up |
| 1726 | chr11 | PRR5L | NM_001160167 | Down |
| 1727 | chr11 | EXT2 | NM_000401 | up |
| 1728 | chr11 | CD82 | NM_002231 | up |
| 1729 | chr11 | TSPAN18 | NM_130783 | Down |
| 1730 | chr11 | TP53I11 | NM_006034 | Down |
| 1731 | chr11 | SYT13 | NM_020826 | Down |
| 1732 | chr11 | PEX16 | NM_004813 | Down |
| 1733 | chr11 | PEX16 | NM_004813 | up |
| 1734 | chr11 | AMBRA1 | NM_017749 | Down |
| 1735 | chr11 | ARHGAP1 | NM_004308 | up |
| 1736 | chr11 | PACSIN3 | NM_016223 | Down |
| 1737 | chr11 | PACSIN3 | NM_016223 | up |

Fig. 2A-40

| | | | | |
|---|---|---|---|---|
| 1738 | chr11 | MADD | NM_130470 | up |
| 1739 | chr11 | MADD | NM_130470 | Down |
| 1740 | chr11 | OR4C12 | NM_001005270 | Down |
| 1741 | chr11 | OR5AS1 | NM_001001921 | up |
| 1742 | chr11 | TNKS1BP1 | NM_033396 | Down |
| 1743 | chr11 | TNKS1BP1 | NM_033396 | up |
| 1744 | chr11 | SLC43A3 | NM_017611 | Down |
| 1745 | chr11 | RTN4RL2 | NM_178570 | Down |
| 1746 | chr11 | SLC43A1 | NM_003627 | up |
| 1747 | chr11 | SERPING1 | NM_000062 | Down |
| 1748 | chr11 | ZDHHC5 | NM_015457 | Down |
| 1749 | chr11 | ZFP91 | NM_053023 | Down |
| 1750 | chr11 | GLYATL2 | NM_145016 | up |
| 1751 | chr11 | MRPL16 | NM_017840 | Down |
| 1752 | chr11 | GIF | NM_005142 | up |
| 1753 | chr11 | CD6 | NM_006725 | Down |
| 1754 | chr11 | CD6 | NM_006725 | Down |
| 1755 | chr11 | DAK | NM_015533 | up |
| 1756 | chr11 | CPSF7 | NM_024811 | Down |
| 1757 | chr11 | C11orf66 | NM_145017 | up |
| 1758 | chr11 | C11orf9 | NM_013279 | Down |
| 1759 | chr11 | C11orf9 | NM_013279 | Down |
| 1760 | chr11 | FEN1 | NM_004111 | Down |
| 1761 | chr11 | MTA2 | NM_004739 | up |
| 1762 | chr11 | MTA2 | NM_004739 | up |
| 1763 | chr11 | MTA2 | NM_004739 | Down |
| 1764 | chr11 | UBXN1 | NM_015853 | Down |
| 1765 | chr11 | NXF1 | NM_006362 | up |
| 1766 | chr11 | NXF1 | NM_006362 | Down |
| 1767 | chr11 | SLC3A2 | NM_001012661 | up |
| 1768 | chr11 | HRASLS5 | NM_054108 | up |
| 1769 | chr11 | RCOR2 | NM_173587 | Down |
| 1770 | chr11 | STIP1 | NM_006819 | up |
| 1771 | chr11 | TRPT1 | NM_001033678 | Down |
| 1772 | chr11 | PLCB3 | NM_000932 | up |
| 1773 | chr11 | PRDX5 | NM_012094 | Down |
| 1774 | chr11 | RPS6KA4 | NM_003942 | Down |
| 1775 | chr11 | SLC22A11 | NM_018484 | up |
| 1776 | chr11 | NRXN2 | NM_015080 | Down |
| 1777 | chr11 | NAALADL1 | NM_005468 | Down |
| 1778 | chr11 | TM7SF2 | NM_003273 | Down |
| 1779 | chr11 | SCYL1 | NM_020680 | Down |
| 1780 | chr11 | LTBP3 | NM_001130144 | Down |
| 1781 | chr11 | SIPA1 | NM_153253 | Down |

Fig. 2A-41

| | | | | |
|---|---|---|---|---|
| 1782 | chr11 | KAT5 | NM_182710 | Down |
| 1783 | chr11 | SNX32 | NM_152760 | Down |
| 1784 | chr11 | EFEMP2 | NM_016938 | up |
| 1785 | chr11 | CTSW | NM_001335 | Down |
| 1786 | chr11 | CCDC85B | NM_006848 | up |
| 1787 | chr11 | ---- | ---- | up |
| 1788 | chr11 | ---- | ---- | Down |
| 1789 | chr11 | BANF1 | NM_003860 | Down |
| 1790 | chr11 | CATSPER1 | NM_053054 | up |
| 1791 | chr11 | CATSPER1 | NM_053054 | Down |
| 1792 | chr11 | RAB1B | NM_030981 | up |
| 1793 | chr11 | TMEM151A | NM_153266 | Down |
| 1794 | chr11 | B3GNT1 | NM_006876 | up |
| 1795 | chr11 | SLC29A2 | NM_001532 | Down |
| 1796 | chr11 | ADRBK1 | NM_001619 | Down |
| 1797 | chr11 | SSH3 | NM_017857 | Down |
| 1798 | chr11 | SSH3 | NM_017857 | up |
| 1799 | chr11 | CARNS1 | NM_001166222 | up |
| 1800 | chr11 | GPR152 | NM_206997 | Down |
| 1801 | chr11 | PITPNM1 | NM_004910 | Down |
| 1802 | chr11 | NUDT8 | NM_181843 | Down |
| 1803 | chr11 | TBX10 | NM_005995 | Down |
| 1804 | chr11 | LRP5 | NM_002335 | up |
| 1805 | chr11 | MTL5 | NM_004923 | up |
| 1806 | chr11 | CPT1A | NM_001031847 | Down |
| 1807 | chr11 | CPT1A | NM_001876 | Down |
| 1808 | chr11 | MRPL21 | NM_181515 | Down |
| 1809 | chr11 | TPCN2 | NM_139075 | Down |
| 1810 | chr11 | FGF19 | NM_005117 | up |
| 1811 | chr11 | FGF3 | NM_005247 | up |
| 1812 | chr11 | ANO1 | NM_018043 | Down |
| 1813 | chr11 | CTTN | NM_005231 | up |
| 1814 | chr11 | INPPL1 | NM_001567 | Down |
| 1815 | chr11 | STARD10 | NM_006645 | Down |
| 1816 | chr11 | ARHGEF17 | NM_014786 | up |
| 1817 | chr11 | RELT | NM_032871 | Down |
| 1818 | chr11 | OR2AT4 | NM_001005285 | Down |
| 1819 | chr11 | SLCO2B1 | NM_007256 | up |
| 1820 | chr11 | ARRB1 | NM_004041 | Down |
| 1821 | chr11 | SERPINH1 | NM_001235 | up |
| 1822 | chr11 | WNT11 | NM_004626 | Down |
| 1823 | chr11 | B3GNT6 | NM_138706 | Down |
| 1824 | chr11 | CAPN5 | NM_004055 | Down |
| 1825 | chr11 | CCDC81 | AK027167 | up |

Fig. 2A-42

| | | | | |
|---|---|---|---|---|
| 1826 | chr11 | NOX4 | BC051371 | up |
| 1827 | chr11 | C11orf70 | BC054869 | Down |
| 1828 | chr11 | YAP1 | NM_001130145 | Down |
| 1829 | chr11 | MMP20 | NM_004771 | Down |
| 1830 | chr11 | MMP8 | NM_002424 | Down |
| 1831 | chr11 | CUL5 | NM_003478 | up |
| 1832 | chr11 | NPAT | NM_002519 | Down |
| 1833 | chr11 | NPAT | NM_002519 | Down |
| 1834 | chr11 | ATM | NM_000051 | up |
| 1835 | chr11 | NCAM1 | NM_000615 | Down |
| 1836 | chr11 | DRD2 | NM_000795 | Down |
| 1837 | chr11 | NNMT | NM_006169 | Down |
| 1838 | chr11 | CADM1 | NM_014333 | Down |
| 1839 | chr11 | SIDT2 | AK303023 | up |
| 1840 | chr11 | RNF214 | NM_207343 | up |
| 1841 | chr11 | BACE1 | NM_012104 | up |
| 1842 | chr11 | CEP164 | NM_014956 | up |
| 1843 | chr11 | DSCAML1 | NM_020693 | Down |
| 1844 | chr11 | UBE4A | NM_004788 | Down |
| 1845 | chr11 | CXCR5 | NM_001716 | up |
| 1846 | chr11 | BCL9L | NM_182557 | Down |
| 1847 | chr11 | BCL9L | NM_182557 | Down |
| 1848 | chr11 | FOXR1 | NM_181721 | Down |
| 1849 | chr11 | SLC37A4 | NM_001164277 | Down |
| 1850 | chr11 | SLC37A4 | NM_001164277 | up |
| 1851 | chr11 | HMBS | NM_000190 | up |
| 1852 | chr11 | H2AFX | NM_002105 | Down |
| 1853 | chr11 | NLRX1 | NM_024618 | Down |
| 1854 | chr11 | USP2 | NM_004205 | Down |
| 1855 | chr11 | GRIK4 | NM_014619 | up |
| 1856 | chr11 | SORL1 | NM_003105 | up |
| 1857 | chr11 | UBASH3B | NM_032873 | Down |
| 1858 | chr11 | OR8G5 | NM_001005198 | up |
| 1859 | chr11 | OR8D2 | NM_001002918 | Down |
| 1860 | chr11 | TBRG1 | NM_032811 | up |
| 1861 | chr11 | ESAM | AY189281 | up |
| 1862 | chr11 | ROBO3 | NM_022370 | Down |
| 1863 | chr11 | SLC37A2 | NM_198277 | Down |
| 1864 | chr11 | DDX25 | NM_013264 | Down |
| 1865 | chr11 | RPUSD4 | NM_032795 | Down |
| 1866 | chr11 | SRPR | NM_003139 | up |
| 1867 | chr11 | KIRREL3 | NM_032531 | Down |
| 1868 | chr11 | ETS1 | NM_001143820 | up |
| 1869 | chr11 | C11orf45 | NM_145013 | Down |

Fig. 2A-43

| | | | | |
|---|---|---|---|---|
| 1870 | chr11 | C11orf45 | NM_145013 | Down |
| 1871 | chr11 | NFRKB | NM_001143835 | Down |
| 1872 | chr11 | NFRKB | NM_001143835 | Down |
| 1873 | chr11 | PRDM10 | NM_020228 | up |
| 1874 | chr11 | APLP2 | NM_001642 | Down |
| 1875 | chr11 | APLP2 | NM_001642 | Down |
| 1876 | chr11 | ST14 | NM_021978 | up |
| 1877 | chr11 | ST14 | NM_021978 | up |
| 1878 | chr11 | ACAD8 | NM_014384 | Down |
| 1879 | chr11 | GLB1L3 | NM_001080407 | Down |
| 1880 | chr12 | SLC6A13 | NM_016615 | Down |
| 1881 | chr12 | NINJ2 | NM_016533 | Down |
| 1882 | chr12 | CACNA2D4 | NM_172364 | up |
| 1883 | chr12 | CACNA2D4 | NM_172364 | Down |
| 1884 | chr12 | CACNA1C | NM_199460 | Down |
| 1885 | chr12 | PLEKHG6 | NM_018173 | Down |
| 1886 | chr12 | LTBR | NM_002342 | Down |
| 1887 | chr12 | LTBR | NM_002342 | up |
| 1888 | chr12 | TAPBPL | NM_018009 | Down |
| 1889 | chr12 | IFFO1 | NM_080730 | Down |
| 1890 | chr12 | IFFO1 | NM_080730 | Down |
| 1891 | chr12 | NOP2 | NM_006170 | Down |
| 1892 | chr12 | GPR162 | NM_019858 | up |
| 1893 | chr12 | LPCAT3 | NM_005768 | up |
| 1894 | chr12 | FAM90A1 | NM_018088 | up |
| 1895 | chr12 | PZP | NM_002864 | Down |
| 1896 | chr12 | CLEC1B | NM_016509 | Down |
| 1897 | chr12 | TAS2R10 | NM_023921 | up |
| 1898 | chr12 | DUSP16 | NM_030640 | Down |
| 1899 | chr12 | EMP1 | NM_001423 | up |
| 1900 | chr12 | C12orf36 | NM_182558 | Down |
| 1901 | chr12 | MGP | NM_000900 | Down |
| 1902 | chr12 | RERGL | NM_024730 | up |
| 1903 | chr12 | PIK3C2G | NM_004570 | up |
| 1904 | chr12 | LDHB | NM_002300 | up |
| 1905 | chr12 | ETNK1 | NM_018638 | up |
| 1906 | chr12 | SOX5 | NM_006940 | up |
| 1907 | chr12 | IFLTD1 | NM_001145728 | up |
| 1908 | chr12 | FLJ13224 | NR_026806 | up |
| 1909 | chr12 | CPNE8 | NM_153634 | up |
| 1910 | chr12 | GXYLT1 | NM_173601 | Down |
| 1911 | chr12 | PPHLN1 | NM_201515 | up |
| 1912 | chr12 | RAPGEF3 | NM_001098531 | Down |
| 1913 | chr12 | RAPGEF3 | NM_001098531 | Down |

Fig. 2A-44

| | | | | |
|---|---|---|---|---|
| 1914 | chr12 | DDX23 | NM_004818 | up |
| 1915 | chr12 | MLL2 | NM_003482 | up |
| 1916 | chr12 | MLL2 | NM_003482 | up |
| 1917 | chr12 | MLL2 | NM_003482 | up |
| 1918 | chr12 | TROAP | NM_005480 | Down |
| 1919 | chr12 | KCNH3 | NM_012284 | up |
| 1920 | chr12 | PRPF40B | NM_001031698 | up |
| 1921 | chr12 | PRPF40B | NM_001031698 | up |
| 1922 | chr12 | NCKAP5L | NM_001037806 | Down |
| 1923 | chr12 | ---- | ---- | Down |
| 1924 | chr12 | METTL7A | NM_014033 | Down |
| 1925 | chr12 | SLC11A2 | NM_001174125 | up |
| 1926 | chr12 | LETMD1 | NM_015416 | Down |
| 1927 | chr12 | BIN2 | NM_016293 | up |
| 1928 | chr12 | ANKRD33 | NM_001130015 | Down |
| 1929 | chr12 | C12orf44 | NM_021934 | up |
| 1930 | chr12 | KRT7 | NM_005556 | Down |
| 1931 | chr12 | SPRYD3 | NM_032840 | Down |
| 1932 | chr12 | ZNF740 | NM_001004304 | up |
| 1933 | chr12 | SP1 | NM_138473 | Down |
| 1934 | chr12 | AMHR2 | NM_020547 | Down |
| 1935 | chr12 | ATF7 | BC042363 | up |
| 1936 | chr12 | COPZ1 | NM_016057 | Down |
| 1937 | chr12 | KIAA0748 | NM_001098815 | up |
| 1938 | chr12 | ITGA7 | NM_001144996 | up |
| 1939 | chr12 | MMP19 | NM_002429 | up |
| 1940 | chr12 | CNPY2 | NM_014255 | up |
| 1941 | chr12 | TIMELESS | NM_003920 | up |
| 1942 | chr12 | PRIM1 | NM_000946 | Down |
| 1943 | chr12 | PRIM1 | NM_000946 | up |
| 1944 | chr12 | LRP1 | NM_002332 | up |
| 1945 | chr12 | LRP1 | NM_002332 | Down |
| 1946 | chr12 | GLI1 | NM_005269 | Down |
| 1947 | chr12 | B4GALNT1 | NM_001478 | Down |
| 1948 | chr12 | CDK4 | NM_000075 | Down |
| 1949 | chr12 | TSFM | NM_001172696 | Down |
| 1950 | chr12 | CTDSP2 | NM_005730 | up |
| 1951 | chr12 | XRCC6BP1 | NM_033276 | Down |
| 1952 | chr12 | MON2 | NM_015026 | up |
| 1953 | chr12 | C12orf66 | NM_152440 | up |
| 1954 | chr12 | GNS | NM_002076 | up |
| 1955 | chr12 | RPSAP52 | NR_026825 | Down |
| 1956 | chr12 | PTPRB | NM_001109754 | up |
| 1957 | chr12 | ZDHHC17 | NM_015336 | Down |

Fig. 2A-45

| | | | | |
|---|---|---|---|---|
| 1958 | chr12 | C12orf50 | BC038413 | up |
| 1959 | chr12 | CEP290 | NM_025114 | Down |
| 1960 | chr12 | C12orf37 | AK058107 | up |
| 1961 | chr12 | PLXNC1 | NM_005761 | Down |
| 1962 | chr12 | NEDD1 | NM_001135175 | up |
| 1963 | chr12 | SLC25A3 | NM_005888 | up |
| 1964 | chr12 | APAF1 | NM_013229 | Down |
| 1965 | chr12 | SCYL2 | NM_017988 | Down |
| 1966 | chr12 | ANO4 | NM_178826 | up |
| 1967 | chr12 | CCDC53 | NM_016053 | up |
| 1968 | chr12 | C12orf42 | NM_198521 | Down |
| 1969 | chr12 | HCFC2 | NM_013320 | up |
| 1970 | chr12 | NUAK1 | NM_014840 | up |
| 1971 | chr12 | POLR3B | NM_018082 | Down |
| 1972 | chr12 | POLR3B | NM_018082 | Down |
| 1973 | chr12 | SART3 | BC041638 | Down |
| 1974 | chr12 | TCHP | NM_032300 | up |
| 1975 | chr12 | GIT2 | NM_057169 | up |
| 1976 | chr12 | C12orf24 | NM_013300 | up |
| 1977 | chr12 | RPL6 | NM_001024662 | up |
| 1978 | chr12 | DTX1 | NM_004416 | Down |
| 1979 | chr12 | DTX1 | NM_004416 | Down |
| 1980 | chr12 | TBX3 | NM_005996 | Down |
| 1981 | chr12 | C12orf49 | AK298857 | Down |
| 1982 | chr12 | FBXW8 | NM_153348 | up |
| 1983 | chr12 | NOS1 | NM_000620 | Down |
| 1984 | chr12 | TAOK3 | NM_016281 | Down |
| 1985 | chr12 | PRKAB1 | NM_006253 | Down |
| 1986 | chr12 | CIT | NM_007174 | Down |
| 1987 | chr12 | PXN | BC052611 | Down |
| 1988 | chr12 | PLA2G1B | NM_000928 | up |
| 1989 | chr12 | MSI1 | NM_002442 | Down |
| 1990 | chr12 | GATC | NM_176818 | up |
| 1991 | chr12 | --- | --- | up |
| 1992 | chr12 | CAMKK2 | NM_006549 | Down |
| 1993 | chr12 | --- | --- | up |
| 1994 | chr12 | --- | --- | Down |
| 1995 | chr12 | KDM2B | NM_032590 | up |
| 1996 | chr12 | KDM2B | NM_032590 | Down |
| 1997 | chr12 | CLIP1 | NM_002956 | up |
| 1998 | chr12 | KNTC1 | NM_014708 | Down |
| 1999 | chr12 | HIP1R | NM_003959 | Down |
| 2000 | chr12 | ZNF664 | NM_152437 | up |
| 2001 | chr12 | FAM101A | NM_181709 | Down |

Fig. 2A-46

| | | | | |
|---|---|---|---|---|
| 2002 | chr12 | NCOR2 | NM_006312 | Down |
| 2003 | chr12 | NCOR2 | NM_006312 | Down |
| 2004 | chr12 | NCOR2 | NM_006312 | up |
| 2005 | chr12 | NCOR2 | NM_006312 | Down |
| 2006 | chr12 | GPR133 | NM_198827 | Down |
| 2007 | chr12 | SFRS8 | NM_004592 | up |
| 2008 | chr12 | ULK1 | NM_003565 | Down |
| 2009 | chr12 | EP400 | NM_015409 | up |
| 2010 | chr12 | POLE | NM_006231 | Down |
| 2011 | chr12 | POLE | NM_006231 | Down |
| 2012 | chr12 | POLE | NM_006231 | up |
| 2013 | chr13 | ITGBL1 | NM_004791 | up |
| 2014 | chr13 | SGCG | NM_000231 | Down |
| 2015 | chr13 | ATP12A | NM_001676 | Down |
| 2016 | chr13 | PABPC3 | NM_030979 | up |
| 2017 | chr13 | FAM123A | NM_152704 | up |
| 2018 | chr13 | ATP8A2 | NM_016529 | Down |
| 2019 | chr13 | PAN3 | NM_175854 | Down |
| 2020 | chr13 | MTUS2 | NM_015233 | Down |
| 2021 | chr13 | MTUS2 | NM_001033602 | Down |
| 2022 | chr13 | OK | AB064667 | up |
| 2023 | chr13 | FRY | NM_023037 | Down |
| 2024 | chr13 | KL | NM_004795 | up |
| 2025 | chr13 | DCLK1 | NM_004734 | Down |
| 2026 | chr13 | POSTN | NM_006475 | up |
| 2027 | chr13 | TRPC4 | NM_016179 | up |
| 2028 | chr13 | UFM1 | NM_016617 | Down |
| 2029 | chr13 | FREM2 | NM_207361 | up |
| 2030 | chr13 | FOXO1 | NM_002015 | Down |
| 2031 | chr13 | ENOX1 | NM_017993 | Down |
| 2032 | chr13 | NUDT15 | NM_018283 | Down |
| 2033 | chr13 | FNDC3A | NM_001079673 | up |
| 2034 | chr13 | FNDC3A | NM_001079673 | up |
| 2035 | chr13 | CCDC70 | NM_031290 | up |
| 2036 | chr13 | NEK3 | NM_002498 | up |
| 2037 | chr13 | KCTD12 | NM_138444 | Down |
| 2038 | chr13 | MYCBP2 | NM_015057 | Down |
| 2039 | chr13 | MYCBP2 | NM_015057 | up |
| 2040 | chr13 | SCEL | NM_144777 | Down |
| 2041 | chr13 | SLITRK5 | NM_015567 | Down |
| 2042 | chr13 | GPC5 | NM_004466 | up |
| 2043 | chr13 | SLC15A1 | NM_005073 | up |
| 2044 | chr13 | ZIC2 | NM_007129 | Down |
| 2045 | chr13 | BIVM | NM_017693 | Down |

Fig. 2A-47

| | | | | |
|---|---|---|---|---|
| 2046 | chr13 | ARGLU1 | BC071587 | up |
| 2047 | chr13 | COL4A2 | NM_001846 | Down |
| 2048 | chr13 | COL4A2 | NM_001846 | Down |
| 2049 | chr13 | COL4A2 | NM_001846 | up |
| 2050 | chr13 | RAB20 | NM_017817 | up |
| 2051 | chr13 | CARS2 | NM_024537 | up |
| 2052 | chr13 | CARS2 | NM_024537 | Down |
| 2053 | chr13 | ING1 | NM_198219 | up |
| 2054 | chr13 | ARHGEF7 | NM_003899 | Down |
| 2055 | chr13 | ARHGEF7 | NM_003899 | Down |
| 2056 | chr13 | ARHGEF7 | NM_003899 | up |
| 2057 | chr13 | ARHGEF7 | NM_003899 | up |
| 2058 | chr13 | PROZ | NM_003891 | Down |
| 2059 | chr13 | PROZ | NM_003891 | Down |
| 2060 | chr13 | CUL4A | NM_001008895 | up |
| 2061 | chr13 | GRTP1 | AK300897 | up |
| 2062 | chr13 | TMCO3 | NM_017905 | up |
| 2063 | chr14 | OSGEP | NM_017807 | up |
| 2064 | chr14 | METT11D1 | NM_001029991 | Down |
| 2065 | chr14 | --- | --- | Down |
| 2066 | chr14 | HNRNPC | NM_031314 | Down |
| 2067 | chr14 | --- | --- | up |
| 2068 | chr14 | SUPT16H | NM_007192 | Down |
| 2069 | chr14 | --- | --- | Down |
| 2070 | chr14 | SLC7A7 | NM_003982 | up |
| 2071 | chr14 | MRPL52 | NM_181304 | Down |
| 2072 | chr14 | SLC7A8 | NM_012244 | Down |
| 2073 | chr14 | SLC7A8 | NM_182728 | up |
| 2074 | chr14 | HOMEZ | NM_020834 | Down |
| 2075 | chr14 | EFS | NM_005864 | Down |
| 2076 | chr14 | MYH6 | NM_002471 | Down |
| 2077 | chr14 | LRRC16B | NM_138360 | Down |
| 2078 | chr14 | FITM1 | BC042179 | Down |
| 2079 | chr14 | RNF31 | NM_017999 | up |
| 2080 | chr14 | IRF9 | NM_006084 | up |
| 2081 | chr14 | IRF9 | NM_006084 | up |
| 2082 | chr14 | TM9SF1 | NM_006405 | up |
| 2083 | chr14 | LTB4R2 | NM_019839 | Down |
| 2084 | chr14 | RIPK3 | NM_006871 | up |
| 2085 | chr14 | KHNYN | NM_015299 | up |
| 2086 | chr14 | STXBP6 | NM_014178 | Down |
| 2087 | chr14 | PRKD1 | NM_002742 | Down |
| 2088 | chr14 | SCFD1 | NM_016106 | up |
| 2089 | chr14 | SCFD1 | NM_016106 | Down |

Fig. 2A-48

| | | | | |
|---|---|---|---|---|
| 2090 | chr14 | HECTD1 | NM_015382 | Down |
| 2091 | chr14 | PPP2R3C | NM_017917 | up |
| 2092 | chr14 | BRMS1L | NM_032352 | Down |
| 2093 | chr14 | FOXA1 | NM_004496 | Down |
| 2094 | chr14 | SEC23A | NM_006364 | up |
| 2095 | chr14 | PNN | NM_002687 | up |
| 2096 | chr14 | PPIL5 | NM_152329 | Down |
| 2097 | chr14 | ARF6 | NM_001663 | up |
| 2098 | chr14 | ATP5S | NM_001003803 | up |
| 2099 | chr14 | MAP4K5 | NM_198794 | Down |
| 2100 | chr14 | NIN | NM_182944 | up |
| 2101 | chr14 | SAMD4A | NM_015589 | Down |
| 2102 | chr14 | LGALS3 | NM_002306 | up |
| 2103 | chr14 | PSMA3 | NM_002788 | Down |
| 2104 | chr14 | DACT1 | NM_016651 | up |
| 2105 | chr14 | SIX4 | NM_017420 | up |
| 2106 | chr14 | SLC38A6 | NM_001172702 | up |
| 2107 | chr14 | HIF1A | NM_001530 | Down |
| 2108 | chr14 | ESR2 | NM_001437 | up |
| 2109 | chr14 | RAB15 | NM_198686 | Down |
| 2110 | chr14 | RDH12 | NM_152443 | Down |
| 2111 | chr14 | ZFYVE26 | NM_015346 | Down |
| 2112 | chr14 | ACTN1 | NM_001130004 | Down |
| 2113 | chr14 | DCAF5 | NM_003861 | Down |
| 2114 | chr14 | --- | --- | up |
| 2115 | chr14 | SLC10A1 | NM_003049 | Down |
| 2116 | chr14 | SMOC1 | NM_001034852 | Down |
| 2117 | chr14 | SLC8A3 | NM_033262 | Down |
| 2118 | chr14 | MAP3K9 | NM_033141 | up |
| 2119 | chr14 | MAP3K9 | NM_033141 | Down |
| 2120 | chr14 | ZFYVE1 | NM_021260 | up |
| 2121 | chr14 | COQ6 | NM_182476 | up |
| 2122 | chr14 | LTBP2 | NM_000428 | Down |
| 2123 | chr14 | LTBP2 | NM_000428 | Down |
| 2124 | chr14 | MLH3 | NM_001040108 | up |
| 2125 | chr14 | NEK9 | NM_033116 | Down |
| 2126 | chr14 | ADCK1 | NM_020421 | Down |
| 2127 | chr14 | NRXN3 | NM_004796 | up |
| 2128 | chr14 | CATSPERB | NM_024764 | up |
| 2129 | chr14 | CPSF2 | NM_017437 | up |
| 2130 | chr14 | CPSF2 | NM_017437 | Down |
| 2131 | chr14 | CHGA | NM_001275 | up |
| 2132 | chr14 | ITPK1 | NM_014216 | up |
| 2133 | chr14 | OTUB2 | NM_023112 | up |

Fig. 2A-49

| | | | | |
|---|---|---|---|---|
| 2134 | chr14 | IFI27 | NM_001130080 | Down |
| 2135 | chr14 | SERPINA9 | NM_175739 | Down |
| 2136 | chr14 | SERPINA13 | NR_015340 | up |
| 2137 | chr14 | DICER1 | NM_177438 | Down |
| 2138 | chr14 | GLRX5 | NM_016417 | Down |
| 2139 | chr14 | C14orf132 | NR_023938 | up |
| 2140 | chr14 | CYP46A1 | NM_006668 | Down |
| 2141 | chr14 | EML1 | NM_001008707 | Down |
| 2142 | chr14 | ---- | ---- | Down |
| 2143 | chr14 | WDR25 | NM_024515 | Down |
| 2144 | chr14 | DLK1 | NM_003836 | Down |
| 2145 | chr14 | DIO3OS | BC065701 | up |
| 2146 | chr14 | WDR20 | NM_181291 | Down |
| 2147 | chr14 | WDR20 | BC030654 | up |
| 2148 | chr14 | CDC42BPB | NM_006035 | Down |
| 2149 | chr14 | TNFAIP2 | NM_006291 | up |
| 2150 | chr14 | CKB | NM_001823 | up |
| 2151 | chr14 | XRCC3 | NM_001100119 | Down |
| 2152 | chr14 | TDRD9 | NM_153046 | Down |
| 2153 | chr14 | KIF26A | NM_015656 | Down |
| 2154 | chr14 | INF2 | NM_022489 | Down |
| 2155 | chr14 | INF2 | NM_022489 | Down |
| 2156 | chr14 | AKT1 | NM_005163 | up |
| 2157 | chr14 | AHNAK2 | NM_138420 | Down |
| 2158 | chr14 | JAG2 | NM_002226 | Down |
| 2159 | chr14 | C14orf80 | NM_001134875 | Down |
| 2160 | chr14 | IGH@ | BC065733 | Down |
| 2161 | chr14 | IGHD | BC063384 | Down |
| 2162 | chr15 | NIPA1 | NM_144599 | up |
| 2163 | chr15 | GOLGA6L2 | BC129821 | up |
| 2164 | chr15 | SNURF | ENST00000401453 | Down |
| 2165 | chr15 | ATP10A | AB051358 | Down |
| 2166 | chr15 | HERC2 | NM_004667 | Down |
| 2167 | chr15 | HERC2 | NM_004667 | Down |
| 2168 | chr15 | TJP1 | NM_003257 | up |
| 2169 | chr15 | KLF13 | NM_015995 | Down |
| 2170 | chr15 | OTUD7A | NM_130901 | Down |
| 2171 | chr15 | C15orf55 | NM_175741 | Down |
| 2172 | chr15 | THBS1 | NM_003246 | up |
| 2173 | chr15 | GPR176 | NM_007223 | up |
| 2174 | chr15 | BMF | NM_001003940 | Down |
| 2175 | chr15 | PLCB2 | NM_004573 | Down |
| 2176 | chr15 | DISP2 | NM_033510 | up |
| 2177 | chr15 | IVD | NM_002225 | Down |

Fig. 2A-50

| | | | | |
|---|---|---|---|---|
| 2178 | chr15 | FAM82A2 | NM_018145 | up |
| 2179 | chr15 | ZFYVE19 | NM_001077268 | Down |
| 2180 | chr15 | PPP1R14D | NM_017726 | Down |
| 2181 | chr15 | RHOV | NM_133639 | up |
| 2182 | chr15 | VPS18 | NM_020857 | up |
| 2183 | chr15 | INO80 | NM_017553 | Down |
| 2184 | chr15 | RTF1 | NM_015138 | up |
| 2185 | chr15 | RPAP1 | NM_015540 | Down |
| 2186 | chr15 | TYRO3 | NM_006293 | Down |
| 2187 | chr15 | TYRO3 | NM_006293 | Down |
| 2188 | chr15 | JMJD7-PLA2G4B | NR_015346 | Down |
| 2189 | chr15 | SPTBN5 | NM_016642 | Down |
| 2190 | chr15 | PLA2G4D | NM_178034 | Down |
| 2191 | chr15 | CAPN3 | NR_027911 | Down |
| 2192 | chr15 | LRRC57 | NM_153260 | up |
| 2193 | chr15 | CDAN1 | NM_138477 | Down |
| 2194 | chr15 | CDAN1 | NM_138477 | Down |
| 2195 | chr15 | UBR1 | NM_174916 | up |
| 2196 | chr15 | UBR1 | NM_174916 | up |
| 2197 | chr15 | ELL3 | NM_025165 | Down |
| 2198 | chr15 | MFAP1 | NM_005926 | Down |
| 2199 | chr15 | DUOX2 | NM_014080 | up |
| 2200 | chr15 | DUOX2 | NM_014080 | Down |
| 2201 | chr15 | C15orf48 | NM_197955 | Down |
| 2202 | chr15 | C15orf21 | NR_022014 | Down |
| 2203 | chr15 | ATP8B4 | NM_024837 | Down |
| 2204 | chr15 | TMOD2 | NM_014548 | up |
| 2205 | chr15 | GNB5 | NM_006578 | Down |
| 2206 | chr15 | MYO5A | NM_000259 | up |
| 2207 | chr15 | ARPP19 | NM_006628 | Down |
| 2208 | chr15 | PIGB | NM_004855 | Down |
| 2209 | chr15 | NEDD4 | NM_006154 | Down |
| 2210 | chr15 | GCOM1 | NM_001018090 | Down |
| 2211 | chr15 | TLN2 | NM_015059 | Down |
| 2212 | chr15 | TPM1 | NM_001018005 | Down |
| 2213 | chr15 | ANKDD1A | NM_182703 | Down |
| 2214 | chr15 | CILP | NM_003613 | up |
| 2215 | chr15 | IGDCC3 | NM_004884 | up |
| 2216 | chr15 | IGDCC4 | NM_020962 | up |
| 2217 | chr15 | RPL4 | NM_000968 | Down |
| 2218 | chr15 | LCTL | NM_207338 | Down |
| 2219 | chr15 | MAP2K5 | NM_145160 | Down |
| 2220 | chr15 | ITGA11 | NM_001004439 | Down |
| 2221 | chr15 | SPESP1 | NM_145658 | Down |

Fig. 2A-51

| | | | | |
|---|---|---|---|---|
| 2222 | chr15 | TLE3 | NM_005078 | Down |
| 2223 | chr15 | PARP6 | NM_020214 | Down |
| 2224 | chr15 | HCN4 | NM_005477 | Down |
| 2225 | chr15 | CD276 | NM_001024736 | Down |
| 2226 | chr15 | PML | NM_033250 | Down |
| 2227 | chr15 | CYP11A1 | NM_000781 | Down |
| 2228 | chr15 | C15orf17 | NM_020447 | up |
| 2229 | chr15 | C15orf39 | NM_015492 | Down |
| 2230 | chr15 | C15orf39 | NM_015492 | up |
| 2231 | chr15 | CSPG4 | NM_001897 | Down |
| 2232 | chr15 | ISL2 | NM_145805 | Down |
| 2233 | chr15 | RCN2 | NM_002902 | Down |
| 2234 | chr15 | TSPAN3 | NM_005724 | up |
| 2235 | chr15 | ADAMTS7 | NM_014272 | up |
| 2236 | chr15 | RASGRF1 | BC040275 | Down |
| 2237 | chr15 | ARNT2 | NM_014862 | up |
| 2238 | chr15 | KIAA1199 | NM_018689 | up |
| 2239 | chr15 | AKAP13 | NM_006738 | up |
| 2240 | chr15 | HAPLN3 | NM_178232 | up |
| 2241 | chr15 | POLG | NM_002693 | Down |
| 2242 | chr15 | KIF7 | NM_198525 | Down |
| 2243 | chr15 | IQGAP1 | NM_003870 | up |
| 2244 | chr15 | CRTC3 | NM_022769 | Down |
| 2245 | chr15 | MAN2A2 | NM_006122 | up |
| 2246 | chr15 | VPS33B | NM_018668 | Down |
| 2247 | chr15 | LYSMD4 | NM_152449 | Down |
| 2248 | chr15 | ADAMTS17 | NM_139057 | up |
| 2249 | chr15 | LRRK1 | NM_024652 | up |
| 2250 | chr15 | PCSK6 | NM_138320 | up |
| 2251 | chr15 | TM2D3 | NM_078474 | Down |
| 2252 | chr16 | SNRNP25 | NM_024571 | up |
| 2253 | chr16 | ITFG3 | NM_032039 | up |
| 2254 | chr16 | RGS11 | NM_183337 | Down |
| 2255 | chr16 | RAB11FIP3 | NM_014700 | Down |
| 2256 | chr16 | FAM195A | AK054811 | up |
| 2257 | chr16 | WDR90 | NM_145294 | Down |
| 2258 | chr16 | RHOT2 | NM_138769 | up |
| 2259 | chr16 | RHOT2 | NM_138769 | up |
| 2260 | chr16 | CCDC78 | NM_001031737 | Down |
| 2261 | chr16 | HAGHL | NM_207112 | Down |
| 2262 | chr16 | NARFL | NM_022493 | Down |
| 2263 | chr16 | MSLN | NM_005823 | Down |
| 2264 | chr16 | MSLN | NM_005823 | up |
| 2265 | chr16 | CACNA1H | NM_021098 | Down |

Fig. 2A-52

| | | | | |
|---|---|---|---|---|
| 2266 | chr16 | UNKL | NM_001037125 | Down |
| 2267 | chr16 | CLCN7 | NM_001287 | Down |
| 2268 | chr16 | CRAMP1L | NM_020825 | up |
| 2269 | chr16 | SPSB3 | NM_080861 | up |
| 2270 | chr16 | SPSB3 | NM_080861 | Down |
| 2271 | chr16 | HAGH | NM_005326 | up |
| 2272 | chr16 | HAGH | NM_005326 | Down |
| 2273 | chr16 | RPL3L | NM_005061 | up |
| 2274 | chr16 | TBL3 | NM_006453 | Down |
| 2275 | chr16 | TRAF7 | NM_032271 | Down |
| 2276 | chr16 | CASKIN1 | NM_020764 | Down |
| 2277 | chr16 | CASKIN1 | NM_020764 | Down |
| 2278 | chr16 | DCI | NM_001919 | Down |
| 2279 | chr16 | ---- | ---- | Down |
| 2280 | chr16 | ---- | ---- | Down |
| 2281 | chr16 | RNPS1 | NM_006711 | Down |
| 2282 | chr16 | ---- | ---- | Down |
| 2283 | chr16 | CCNF | NM_001761 | up |
| 2284 | chr16 | PRSS27 | NM_031948 | up |
| 2285 | chr16 | SRRM2 | NM_016333 | Down |
| 2286 | chr16 | ---- | ---- | Down |
| 2287 | chr16 | PRSS22 | NM_022119 | Down |
| 2288 | chr16 | TNFRSF12A | NM_016639 | up |
| 2289 | chr16 | ZNF263 | NM_005741 | up |
| 2290 | chr16 | NLRC3 | NM_178844 | up |
| 2291 | chr16 | TRAP1 | NM_016292 | up |
| 2292 | chr16 | TRAP1 | NM_016292 | Down |
| 2293 | chr16 | CREBBP | NM_004380 | Down |
| 2294 | chr16 | CREBBP | NM_004380 | up |
| 2295 | chr16 | ADCY9 | NM_001116 | Down |
| 2296 | chr16 | ADCY9 | NM_001116 | Down |
| 2297 | chr16 | CORO7 | NM_024535 | Down |
| 2298 | chr16 | DNAJA3 | NM_005147 | Down |
| 2299 | chr16 | NMRAL1 | ENST00000404295 | Down |
| 2300 | chr16 | MGRN1 | NM_015246 | up |
| 2301 | chr16 | ROGDI | NM_024589 | up |
| 2302 | chr16 | SEC14L5 | NM_014692 | Down |
| 2303 | chr16 | NAGPA | NM_016256 | Down |
| 2304 | chr16 | C16orf72 | NM_014117 | Down |
| 2305 | chr16 | CIITA | NM_000246 | Down |
| 2306 | chr16 | TXNDC11 | NM_015914 | up |
| 2307 | chr16 | RSL1D1 | NM_015659 | Down |
| 2308 | chr16 | CPPED1 | NM_018340 | Down |
| 2309 | chr16 | MYH11 | NM_002474 | up |

Fig. 2A-53

| | | | | |
|---|---|---|---|---|
| 2310 | chr16 | ABCC1 | NM_004996 | Down |
| 2311 | chr16 | ABCC1 | NM_004996 | up |
| 2312 | chr16 | ABCC6 | NM_001171 | up |
| 2313 | chr16 | ABCC6 | NM_001171 | Down |
| 2314 | chr16 | XYLT1 | NM_022166 | Down |
| 2315 | chr16 | TMC5 | NM_001105248 | up |
| 2316 | chr16 | DNAH3 | NM_017539 | up |
| 2317 | chr16 | VWA3A | NM_173615 | Down |
| 2318 | chr16 | POLR3E | NM_018119 | Down |
| 2319 | chr16 | CDR2 | NM_001802 | up |
| 2320 | chr16 | ERN2 | NM_033266 | Down |
| 2321 | chr16 | ERN2 | NM_033266 | Down |
| 2322 | chr16 | SLC5A11 | NM_052944 | Down |
| 2323 | chr16 | XPO6 | NM_015171 | up |
| 2324 | chr16 | TAOK2 | NM_004783 | Down |
| 2325 | chr16 | GDPD3 | NM_024307 | Down |
| 2326 | chr16 | ITGAL | NM_002209 | Down |
| 2327 | chr16 | RNF40 | NM_014771 | Down |
| 2328 | chr16 | ITGAM | NM_001145808 | Down |
| 2329 | chr16 | ITGAM | NM_001145808 | up |
| 2330 | chr16 | ITGAX | NM_000887 | Down |
| 2331 | chr16 | ITGAX | NM_000887 | up |
| 2332 | chr16 | ZNF843 | NM_001136509 | up |
| 2333 | chr16 | ARMC5 | NM_024742 | up |
| 2334 | chr16 | SLC5A2 | NM_003041 | Down |
| 2335 | chr16 | GPT2 | NM_133443 | Down |
| 2336 | chr16 | ABCC11 | NM_032583 | up |
| 2337 | chr16 | ADCY7 | NM_001114 | Down |
| 2338 | chr16 | SALL1 | NM_002968 | up |
| 2339 | chr16 | RBL2 | NM_005611 | up |
| 2340 | chr16 | OGFOD1 | NM_018233 | up |
| 2341 | chr16 | NLRC5 | NM_032206 | up |
| 2342 | chr16 | GPR56 | NM_005682 | up |
| 2343 | chr16 | GPR56 | NM_005682 | up |
| 2344 | chr16 | GPR97 | NM_170776 | Down |
| 2345 | chr16 | KIFC3 | NM_005550 | up |
| 2346 | chr16 | CNGB1 | NM_001297 | Down |
| 2347 | chr16 | CNGB1 | NM_001297 | Down |
| 2348 | chr16 | MMP15 | NM_002428 | Down |
| 2349 | chr16 | CCDC113 | NM_014157 | Down |
| 2350 | chr16 | PRSS54 | NM_001080492 | up |
| 2351 | chr16 | PRSS54 | NM_001080492 | Down |
| 2352 | chr16 | SETD6 | NM_001160305 | Down |
| 2353 | chr16 | SLC38A7 | NM_018231 | up |

Fig. 2A-54

| | | | | |
|---|---|---|---|---|
| 2354 | chr16 | CMTM1 | NM_181269 | Down |
| 2355 | chr16 | CDH16 | NM_004062 | up |
| 2356 | chr16 | C16orf70 | NM_025187 | up |
| 2357 | chr16 | NOL3 | NM_003946 | up |
| 2358 | chr16 | E2F4 | NM_001950 | Down |
| 2359 | chr16 | ELMO3 | NM_024712 | Down |
| 2360 | chr16 | ELMO3 | NM_024712 | up |
| 2361 | chr16 | FHOD1 | NM_013241 | up |
| 2362 | chr16 | ZDHHC1 | NM_013304 | Down |
| 2363 | chr16 | FAM65A | NM_024519 | up |
| 2364 | chr16 | C16orf48 | BC008284 | up |
| 2365 | chr16 | SLC12A4 | NM_005072 | up |
| 2366 | chr16 | DDX28 | NM_018380 | up |
| 2367 | chr16 | PRMT7 | NM_019023 | up |
| 2368 | chr16 | PRMT7 | NM_019023 | Down |
| 2369 | chr16 | PRMT7 | NM_019023 | up |
| 2370 | chr16 | PRMT7 | NM_019023 | up |
| 2371 | chr16 | SMPD3 | NM_018667 | up |
| 2372 | chr16 | COG8 | NM_032382 | up |
| 2373 | chr16 | SF3B3 | NM_012426 | up |
| 2374 | chr16 | HYDIN | AK299348 | up |
| 2375 | chr16 | AP1G1 | NM_001030007 | up |
| 2376 | chr16 | DHODH | NM_001361 | Down |
| 2377 | chr16 | ZFHX3 | NM_006885 | up |
| 2378 | chr16 | ZNRF1 | NM_032268 | Down |
| 2379 | chr16 | BCAR1 | NM_001170714 | Down |
| 2380 | chr16 | --- | --- | Down |
| 2381 | chr16 | ADAMTS18 | NM_199355 | Down |
| 2382 | chr16 | CDYL2 | NM_152342 | up |
| 2383 | chr16 | PKD1L2 | NM_052892 | Down |
| 2384 | chr16 | PLCG2 | NM_002661 | up |
| 2385 | chr16 | CDH13 | NM_001257 | up |
| 2386 | chr16 | NECAB2 | NM_019065 | Down |
| 2387 | chr16 | LRRC50 | NM_178452 | Down |
| 2388 | chr16 | KCNG4 | NM_172347 | Down |
| 2389 | chr16 | ATP2C2 | NM_014861 | up |
| 2390 | chr16 | ATP2C2 | NM_014861 | up |
| 2391 | chr16 | KIAA1609 | NM_020947 | Down |
| 2392 | chr16 | CRISPLD2 | NM_031476 | Down |
| 2393 | chr16 | ZDHHC7 | NM_001145548 | up |
| 2394 | chr16 | KIAA0182 | NM_014615 | up |
| 2395 | chr16 | GINS2 | NM_016095 | Down |
| 2396 | chr16 | C16orf74 | BC009078 | up |
| 2397 | chr16 | KLHDC4 | NM_017566 | Down |

Fig. 2A-55

| | | | | |
|---|---|---|---|---|
| 2398 | chr16 | ZFPM1 | NM_153813 | Down |
| 2399 | chr16 | IL17C | NM_013278 | Down |
| 2400 | chr16 | FAM38A | NM_001142864 | up |
| 2401 | chr16 | FAM38A | NM_001142864 | Down |
| 2402 | chr16 | FLJ40448 | ENST00000333666 | Down |
| 2403 | chr16 | ANKRD11 | NM_013275 | Down |
| 2404 | chr16 | SPG7 | NM_003119 | Down |
| 2405 | chr16 | CDK10 | NM_052988 | Down |
| 2406 | chr16 | CDK10 | NM_052988 | Down |
| 2407 | chr16 | FANCA | NM_000135 | Down |
| 2408 | chr16 | AFG3L1 | NR_003226 | up |
| 2409 | chr17 | FAM57A | NM_024792 | Down |
| 2410 | chr17 | MYO1C | NM_001080779 | Down |
| 2411 | chr17 | MYO1C | NM_001080779 | up |
| 2412 | chr17 | PITPNA | NM_006224 | up |
| 2413 | chr17 | PITPNA | NM_006224 | up |
| 2414 | chr17 | WDR81 | NM_001163809 | up |
| 2415 | chr17 | WDR81 | NM_001163809 | up |
| 2416 | chr17 | SMYD4 | NM_052928 | up |
| 2417 | chr17 | TSR1 | NM_018128 | up |
| 2418 | chr17 | SGSM2 | NM_014853 | Down |
| 2419 | chr17 | MNT | NM_020310 | Down |
| 2420 | chr17 | KIAA0664 | NM_015229 | Down |
| 2421 | chr17 | KIAA0664 | NM_015229 | up |
| 2422 | chr17 | OR1G1 | NM_003555 | Down |
| 2423 | chr17 | CAMKK1 | NM_032294 | Down |
| 2424 | chr17 | CAMKK1 | NM_032294 | Down |
| 2425 | chr17 | ATP2A3 | NM_005173 | Down |
| 2426 | chr17 | ATP2A3 | NM_005173 | up |
| 2427 | chr17 | ZZEF1 | NM_015113 | Down |
| 2428 | chr17 | CYB5D2 | NM_144611 | Down |
| 2429 | chr17 | MINK1 | NM_015716 | Down |
| 2430 | chr17 | RNF167 | NM_015528 | Down |
| 2431 | chr17 | INCA1 | NM_001167986 | Down |
| 2432 | chr17 | KIF1C | NM_006612 | Down |
| 2433 | chr17 | PITPNM3 | NM_031220 | up |
| 2434 | chr17 | BCL6B | NM_181844 | Down |
| 2435 | chr17 | DLG4 | NM_001365 | Down |
| 2436 | chr17 | ACADVL | NM_000018 | Down |
| 2437 | chr17 | DVL2 | NM_004422 | Down |
| 2438 | chr17 | DVL2 | NM_004422 | up |
| 2439 | chr17 | GABARAP | NM_007278 | up |
| 2440 | chr17 | SLC2A4 | NM_001042 | Down |
| 2441 | chr17 | KCTD11 | NM_001002914 | Down |

Fig. 2A-56

| | | | | |
|---|---|---|---|---|
| 2442 | chr17 | TMEM95 | NM_198154 | up |
| 2443 | chr17 | PLSCR3 | NM_020360 | up |
| 2444 | chr17 | CHRNB1 | NM_000747 | Down |
| 2445 | chr17 | CHRNB1 | NM_000747 | up |
| 2446 | chr17 | SENP3 | NM_015670 | up |
| 2447 | chr17 | SHBG | NM_001040 | Down |
| 2448 | chr17 | EFNB3 | NM_001406 | Down |
| 2449 | chr17 | CHD3 | NM_001005273 | up |
| 2450 | chr17 | TRAPPC1 | NM_021210 | up |
| 2451 | chr17 | CNTROB | NM_053051 | Down |
| 2452 | chr17 | CNTROB | NM_053051 | up |
| 2453 | chr17 | GUCY2D | NM_000180 | up |
| 2454 | chr17 | PER1 | NM_002616 | Down |
| 2455 | chr17 | AURKB | NM_004217 | Down |
| 2456 | chr17 | PFAS | NM_012393 | Down |
| 2457 | chr17 | PFAS | NM_012393 | up |
| 2458 | chr17 | ODF4 | NM_153007 | Down |
| 2459 | chr17 | NTN1 | NM_004822 | up |
| 2460 | chr17 | WDR16 | NM_145054 | Down |
| 2461 | chr17 | MYH13 | NM_003802 | Down |
| 2462 | chr17 | MYH8 | NM_002472 | up |
| 2463 | chr17 | MYH8 | NM_002472 | Down |
| 2464 | chr17 | MYH4 | NM_017533 | up |
| 2465 | chr17 | MYH1 | NM_005963 | up |
| 2466 | chr17 | TTC19 | NM_017775 | Down |
| 2467 | chr17 | NCOR1 | NM_006311 | Down |
| 2468 | chr17 | TRPV2 | NM_016113 | Down |
| 2469 | chr17 | RASD1 | NM_016084 | up |
| 2470 | chr17 | RAI1 | ENST00000395774 | up |
| 2471 | chr17 | DRG2 | NM_001388 | Down |
| 2472 | chr17 | DRG2 | NM_001388 | up |
| 2473 | chr17 | MYO15A | NM_016239 | up |
| 2474 | chr17 | LLGL1 | NM_004140 | up |
| 2475 | chr17 | FLII | NM_002018 | Down |
| 2476 | chr17 | SLC47A1 | NM_018242 | up |
| 2477 | chr17 | ULK2 | NM_014683 | up |
| 2478 | chr17 | AKAP10 | NM_007202 | up |
| 2479 | chr17 | USP22 | NM_015276 | Down |
| 2480 | chr17 | --- | --- | up |
| 2481 | chr17 | --- | --- | Down |
| 2482 | chr17 | --- | --- | Down |
| 2483 | chr17 | --- | --- | Down |
| 2484 | chr17 | NOS2 | NM_000625 | up |
| 2485 | chr17 | FLJ40504 | NR_028334 | Down |

Fig. 2A-57

| | | | | |
|---|---|---|---|---|
| 2486 | chr17 | VTN | NM_000638 | Down |
| 2487 | chr17 | SARM1 | NM_015077 | Down |
| 2488 | chr17 | SPAG5 | NM_006461 | Down |
| 2489 | chr17 | SUPT6H | NM_003170 | up |
| 2490 | chr17 | PIPOX | NM_016518 | up |
| 2491 | chr17 | PIPOX | NM_016518 | Down |
| 2492 | chr17 | PIPOX | NM_016518 | up |
| 2493 | chr17 | MYO18A | NM_078471 | Down |
| 2494 | chr17 | GIT1 | NM_001085454 | Down |
| 2495 | chr17 | CORO6 | NM_032854 | up |
| 2496 | chr17 | RAB11FIP4 | NM_032932 | up |
| 2497 | chr17 | SUZ12 | NM_015355 | Down |
| 2498 | chr17 | ZNF207 | NM_003457 | up |
| 2499 | chr17 | SPACA3 | NM_173847 | Down |
| 2500 | chr17 | TMEM132E | NM_207313 | up |
| 2501 | chr17 | C17orf66 | NM_152781 | Down |
| 2502 | chr17 | SYNRG | NM_007247 | Down |
| 2503 | chr17 | GPR179 | NM_001004334 | Down |
| 2504 | chr17 | PSMB3 | NM_002795 | up |
| 2505 | chr17 | CACNB1 | NM_000723 | up |
| 2506 | chr17 | RPL19 | NM_000981 | Down |
| 2507 | chr17 | MED1 | NM_004774 | up |
| 2508 | chr17 | CDK12 | NM_016507 | up |
| 2509 | chr17 | PNMT | NM_002686 | up |
| 2510 | chr17 | ERBB2 | NM_004448 | Down |
| 2511 | chr17 | MED24 | NM_014815 | Down |
| 2512 | chr17 | NR1D1 | NM_021724 | Down |
| 2513 | chr17 | CDC6 | NM_001254 | Down |
| 2514 | chr17 | IGFBP4 | NM_001552 | up |
| 2515 | chr17 | KRT27 | NM_181537 | up |
| 2516 | chr17 | KRT16 | NM_005557 | Down |
| 2517 | chr17 | SC65 | NM_006455 | up |
| 2518 | chr17 | NT5C3L | NR_033465 | Down |
| 2519 | chr17 | ZNF385C | ENST00000436535 | up |
| 2520 | chr17 | DHX58 | NM_024119 | Down |
| 2521 | chr17 | HCRT | NM_001524 | Down |
| 2522 | chr17 | STAT3 | NM_139276 | Down |
| 2523 | chr17 | STAT3 | NM_139276 | up |
| 2524 | chr17 | PTRF | NM_012232 | Down |
| 2525 | chr17 | PTRF | NM_012232 | Down |
| 2526 | chr17 | COASY | NM_025233 | up |
| 2527 | chr17 | PLEKHH3 | NM_024927 | Down |
| 2528 | chr17 | PLEKHH3 | NM_024927 | up |
| 2529 | chr17 | PLEKHH3 | NM_024927 | up |

Fig. 2A-58

| | | | | |
|---|---|---|---|---|
| 2530 | chr17 | CNTNAP1 | NM_003632 | Down |
| 2531 | chr17 | VPS25 | NM_032353 | Down |
| 2532 | chr17 | LOC388387 | NR_027254 | up |
| 2533 | chr17 | MPP2 | NM_005374 | Down |
| 2534 | chr17 | TMEM101 | NM_032376 | up |
| 2535 | chr17 | ITGA2B | NM_000419 | Down |
| 2536 | chr17 | ADAM11 | NM_002390 | up |
| 2537 | chr17 | GFAP | NM_002055 | up |
| 2538 | chr17 | MAP3K14 | NM_003954 | up |
| 2539 | chr17 | ARHGAP27 | NM_199282 | Down |
| 2540 | chr17 | SCRN2 | NM_138355 | Down |
| 2541 | chr17 | SCRN2 | NM_138355 | Down |
| 2542 | chr17 | FAM117A | NM_030802 | up |
| 2543 | chr17 | MYST2 | NM_007067 | Down |
| 2544 | chr17 | --- | --- | Down |
| 2545 | chr17 | TAC4 | NM_170685 | up |
| 2546 | chr17 | ITGA3 | NM_002204 | Down |
| 2547 | chr17 | PPP1R9B | NM_032595 | Down |
| 2548 | chr17 | PPP1R9B | NM_032595 | Down |
| 2549 | chr17 | MRPL27 | NM_016504 | Down |
| 2550 | chr17 | CHAD | NM_001267 | Down |
| 2551 | chr17 | RSAD1 | NM_018346 | Down |
| 2552 | chr17 | EPN3 | NM_017957 | up |
| 2553 | chr17 | EPN3 | NM_017957 | Down |
| 2554 | chr17 | ABCC3 | NM_003786 | up |
| 2555 | chr17 | ABCC3 | NM_003786 | Down |
| 2556 | chr17 | ABCC3 | NM_003786 | up |
| 2557 | chr17 | WFIKKN2 | NM_175575 | Down |
| 2558 | chr17 | UTP18 | NM_016001 | up |
| 2559 | chr17 | KIF2B | NM_032559 | Down |
| 2560 | chr17 | TRIM25 | NM_005082 | Down |
| 2561 | chr17 | SFRS1 | NM_006924 | Down |
| 2562 | chr17 | EPX | NM_000502 | up |
| 2563 | chr17 | EPX | NM_000502 | Down |
| 2564 | chr17 | MPO | NM_000250 | Down |
| 2565 | chr17 | BZRAP1 | NM_004758 | Down |
| 2566 | chr17 | BZRAP1 | NM_004758 | up |
| 2567 | chr17 | TMEM49 | NM_030938 | Down |
| 2568 | chr17 | USP32 | NM_032582 | up |
| 2569 | chr17 | PPM1D | NM_003620 | Down |
| 2570 | chr17 | BCAS3 | NM_001099432 | Down |
| 2571 | chr17 | BCAS3 | NM_001099432 | Down |
| 2572 | chr17 | TBX2 | NM_005994 | up |
| 2573 | chr17 | C17orf82 | NM_203425 | Down |

Fig. 2A-59

| | | | | |
|---|---|---|---|---|
| 2574 | chr17 | TBX4 | NM_018488 | up |
| 2575 | chr17 | ACE | NM_152830 | Down |
| 2576 | chr17 | TACO1 | NM_016360 | Down |
| 2577 | chr17 | CCDC47 | NM_020198 | up |
| 2578 | chr17 | SMARCD2 | NM_001098426 | Down |
| 2579 | chr17 | CD79B | NM_000626 | up |
| 2580 | chr17 | ERN1 | NM_001433 | Down |
| 2581 | chr17 | GNA13 | NM_006572 | Down |
| 2582 | chr17 | ARSG | NM_014960 | up |
| 2583 | chr17 | WIPI1 | NM_017983 | Down |
| 2584 | chr17 | FAM20A | NR_027751 | Down |
| 2585 | chr17 | ABCA8 | NM_007168 | up |
| 2586 | chr17 | SOX9 | NM_000346 | up |
| 2587 | chr17 | COG1 | NM_018714 | Down |
| 2588 | chr17 | TTYH2 | NM_032646 | Down |
| 2589 | chr17 | CD300A | NM_007261 | up |
| 2590 | chr17 | CD300LF | NM_139018 | up |
| 2591 | chr17 | GRIN2C | NM_000835 | up |
| 2592 | chr17 | LLGL2 | NM_004524 | up |
| 2593 | chr17 | LLGL2 | NM_004524 | up |
| 2594 | chr17 | SAP30BP | NM_013260 | Down |
| 2595 | chr17 | ITGB4 | NM_000213 | Down |
| 2596 | chr17 | ITGB4 | NM_000213 | up |
| 2597 | chr17 | EXOC7 | NM_001013839 | Down |
| 2598 | chr17 | FAM100B | NM_182565 | Down |
| 2599 | chr17 | QRICH2 | NM_032134 | up |
| 2600 | chr17 | SPHK1 | NM_021972 | Down |
| 2601 | chr17 | UBE2O | NM_022066 | up |
| 2602 | chr17 | RHBDF2 | NM_024599 | Down |
| 2603 | chr17 | RHBDF2 | NM_024599 | Down |
| 2604 | chr17 | RHBDF2 | NM_024599 | up |
| 2605 | chr17 | RHBDF2 | NM_024599 | up |
| 2606 | chr17 | TMC8 | NM_152468 | Down |
| 2607 | chr17 | TK1 | NM_003258 | Down |
| 2608 | chr17 | GAA | NM_000152 | Down |
| 2609 | chr17 | CARD14 | NM_024110 | up |
| 2610 | chr17 | RNF213 | NM_020914 | Down |
| 2611 | chr17 | RNF213 | NM_020914 | up |
| 2612 | chr17 | NPTX1 | NM_002522 | Down |
| 2613 | chr17 | C17orf56 | BC064483 | up |
| 2614 | chr17 | C17orf56 | BC064483 | up |
| 2615 | chr17 | TSPAN10 | NM_031945 | up |
| 2616 | chr17 | CCDC137 | NM_199287 | Down |
| 2617 | chr17 | HGS | NM_004712 | Down |

Fig. 2A-60

| | | | | |
|---|---|---|---|---|
| 2618 | chr17 | HGS | NM_004712 | Down |
| 2619 | chr17 | SLC25A10 | NM_012140 | Down |
| 2620 | chr17 | STRA13 | NM_144998 | up |
| 2621 | chr17 | DCXR | NM_016286 | Down |
| 2622 | chr17 | GPS1 | NM_212492 | Down |
| 2623 | chr17 | CCDC57 | ENST00000392346 | up |
| 2624 | chr17 | CSNK1D | NM_001893 | Down |
| 2625 | chr17 | NARF | NM_012336 | Down |
| 2626 | chr17 | NARF | NM_012336 | Down |
| 2627 | chr18 | ENOSF1 | NM_017512 | up |
| 2628 | chr18 | TGIF1 | NM_003244 | Down |
| 2629 | chr18 | DLGAP1 | NM_004746 | Down |
| 2630 | chr18 | EPB41L3 | NM_012307 | Down |
| 2631 | chr18 | EPB41L3 | BC008377 | Down |
| 2632 | chr18 | L3MBTL4 | NM_173464 | up |
| 2633 | chr18 | KIAA0802 | BC040542 | Down |
| 2634 | chr18 | FAM38B | NM_022068 | up |
| 2635 | chr18 | IMPA2 | NM_014214 | Down |
| 2636 | chr18 | SLMO1 | NM_001142405 | up |
| 2637 | chr18 | PTPN2 | NM_002828 | Down |
| 2638 | chr18 | CEP192 | NM_032142 | up |
| 2639 | chr18 | C18orf1 | NM_181481 | Down |
| 2640 | chr18 | GREB1L | AK293321 | up |
| 2641 | chr18 | LAMA3 | NM_198129 | up |
| 2642 | chr18 | DSC3 | NM_001941 | Down |
| 2643 | chr18 | B4GALT6 | NM_004775 | Down |
| 2644 | chr18 | C18orf34 | NM_001105528 | up |
| 2645 | chr18 | MOCOS | NM_017947 | Down |
| 2646 | chr18 | MOCOS | NM_017947 | Down |
| 2647 | chr18 | KIAA1328 | NM_020776 | up |
| 2648 | chr18 | SETBP1 | NM_015559 | up |
| 2649 | chr18 | CXXC1 | NM_001101654 | Down |
| 2650 | chr18 | ME2 | NM_002396 | Down |
| 2651 | chr18 | TCF4 | NM_001083962 | Down |
| 2652 | chr18 | ONECUT2 | NM_004852 | up |
| 2653 | chr18 | FECH | NM_001012515 | up |
| 2654 | chr18 | --- | --- | Down |
| 2655 | chr18 | --- | --- | Down |
| 2656 | chr18 | MALT1 | NM_006785 | up |
| 2657 | chr18 | CDH7 | NM_033646 | Down |
| 2658 | chr18 | ZADH2 | NM_175907 | Down |
| 2659 | chr18 | ATP9B | NM_198531 | up |
| 2660 | chr18 | NFATC1 | NM_172390 | Down |
| 2661 | chr19 | BSG | NM_198591 | Down |

Fig. 2A-61

| | | | | |
|---|---|---|---|---|
| 2662 | chr19 | BSG | NM_001728 | Down |
| 2663 | chr19 | PALM | NM_002579 | Down |
| 2664 | chr19 | MED16 | NM_005481 | Down |
| 2665 | chr19 | C19orf6 | NM_001033026 | Down |
| 2666 | chr19 | GPX4 | NM_002085 | up |
| 2667 | chr19 | SBNO2 | NM_014963 | Down |
| 2668 | chr19 | SBNO2 | NM_014963 | up |
| 2669 | chr19 | C19orf26 | NM_152769 | Down |
| 2670 | chr19 | C19orf26 | NM_152769 | Down |
| 2671 | chr19 | CIRBP | NM_001280 | up |
| 2672 | chr19 | MUM1 | NM_032853 | Down |
| 2673 | chr19 | APC2 | NM_005883 | Down |
| 2674 | chr19 | APC2 | NM_005883 | Down |
| 2675 | chr19 | APC2 | NM_005883 | Down |
| 2676 | chr19 | PCSK4 | NM_017573 | Down |
| 2677 | chr19 | TCF3 | NM_003200 | Down |
| 2678 | chr19 | ATP8B3 | NM_138813 | up |
| 2679 | chr19 | REXO1 | NM_020695 | up |
| 2680 | chr19 | MKNK2 | NM_017572 | Down |
| 2681 | chr19 | MOBKL2A | NM_130807 | Down |
| 2682 | chr19 | AP3D1 | NM_001077523 | up |
| 2683 | chr19 | AP3D1 | NM_001077523 | Down |
| 2684 | chr19 | AP3D1 | NM_001077523 | up |
| 2685 | chr19 | DOT1L | NM_032482 | Down |
| 2686 | chr19 | PLEKHJ1 | NM_018049 | up |
| 2687 | chr19 | C19orf35 | NM_198532 | Down |
| 2688 | chr19 | SPPL2B | NM_152988 | up |
| 2689 | chr19 | GADD45B | NM_015675 | Down |
| 2690 | chr19 | ZNF77 | NM_021217 | up |
| 2691 | chr19 | GNA15 | NM_002068 | Down |
| 2692 | chr19 | NCLN | NM_020170 | up |
| 2693 | chr19 | NCLN | NM_020170 | up |
| 2694 | chr19 | CELF5 | NR_033342 | Down |
| 2695 | chr19 | FZR1 | NM_001136198 | up |
| 2696 | chr19 | MRPL54 | NM_172251 | Down |
| 2697 | chr19 | DAPK3 | NM_001348 | Down |
| 2698 | chr19 | EEF2 | NM_001961 | Down |
| 2699 | chr19 | DPP9 | NM_139159 | Down |
| 2700 | chr19 | C19orf30 | NR_027148 | Down |
| 2701 | chr19 | TICAM1 | NM_182919 | up |
| 2702 | chr19 | PLIN3 | NM_005817 | Down |
| 2703 | chr19 | PTPRS | NM_002850 | Down |
| 2704 | chr19 | PTPRS | NM_002850 | up |
| 2705 | chr19 | ZNRF4 | NM_181710 | Down |

Fig. 2A-62

| | | | | |
|---|---|---|---|---|
| 2706 | chr19 | NRTN | NM_004558 | Down |
| 2707 | chr19 | FUT6 | NM_000150 | Down |
| 2708 | chr19 | RFX2 | NM_000635 | up |
| 2709 | chr19 | GTF2F1 | NM_002096 | up |
| 2710 | chr19 | KHSRP | NM_003685 | Down |
| 2711 | chr19 | SLC25A23 | NM_024103 | Down |
| 2712 | chr19 | DENND1C | NM_024898 | Down |
| 2713 | chr19 | CD70 | NM_001252 | Down |
| 2714 | chr19 | INSR | NM_000208 | up |
| 2715 | chr19 | ARHGEF18 | NM_015318 | up |
| 2716 | chr19 | EVI5L | NM_001159944 | Down |
| 2717 | chr19 | MAP2K7 | NM_145185 | Down |
| 2718 | chr19 | SNAPC2 | NM_003083 | Down |
| 2719 | chr19 | ELAVL1 | NM_001419 | Down |
| 2720 | chr19 | CD320 | NM_016579 | Down |
| 2721 | chr19 | KANK3 | NM_198471 | up |
| 2722 | chr19 | HNRNPM | NM_005968 | Down |
| 2723 | chr19 | ---- | --- | Down |
| 2724 | chr19 | ---- | --- | Down |
| 2725 | chr19 | ADAMTS10 | NM_030957 | Down |
| 2726 | chr19 | ZNF317 | NM_020933 | Down |
| 2727 | chr19 | OR7D4 | NM_001005191 | Down |
| 2728 | chr19 | COL5A3 | NM_015719 | up |
| 2729 | chr19 | C19orf66 | NM_018381 | up |
| 2730 | chr19 | DNMT1 | NM_001130823 | up |
| 2731 | chr19 | ICAM4 | NM_001544 | up |
| 2732 | chr19 | RAVER1 | NM_133452 | Down |
| 2733 | chr19 | RAVER1 | NM_133452 | Down |
| 2734 | chr19 | ATG4D | NM_032885 | Down |
| 2735 | chr19 | ATG4D | NM_032885 | Down |
| 2736 | chr19 | SLC44A2 | NM_020428 | Down |
| 2737 | chr19 | QTRT1 | NM_031209 | Down |
| 2738 | chr19 | LDLR | NM_000527 | up |
| 2739 | chr19 | LOC55908 | NM_018687 | Down |
| 2740 | chr19 | RAB3D | NM_004283 | Down |
| 2741 | chr19 | EPOR | NM_000121 | Down |
| 2742 | chr19 | CCDC151 | NM_145045 | up |
| 2743 | chr19 | ZNF44 | BC136502 | Down |
| 2744 | chr19 | ZNF709 | NM_152601 | up |
| 2745 | chr19 | MAN2B1 | NM_000528 | up |
| 2746 | chr19 | C19orf56 | NM_016145 | up |
| 2747 | chr19 | TNPO2 | NM_001136196 | Down |
| 2748 | chr19 | ASNA1 | NM_004317 | up |
| 2749 | chr19 | JUNB | NM_002229 | up |

Fig. 2A-63

| | | | | |
|---|---|---|---|---|
| 2750 | chr19 | MAST1 | NM_014975 | up |
| 2751 | chr19 | GCDH | NM_000159 | Down |
| 2752 | chr19 | CALR | NM_004343 | Down |
| 2753 | chr19 | NFIX | NM_002501 | Down |
| 2754 | chr19 | CACNA1A | NM_000068 | Down |
| 2755 | chr19 | CACNA1A | NM_000068 | up |
| 2756 | chr19 | --- | --- | Down |
| 2757 | chr19 | DCAF15 | NM_138353 | up |
| 2758 | chr19 | RFX1 | NM_002918 | Down |
| 2759 | chr19 | DDX39 | NM_005804 | Down |
| 2760 | chr19 | PKN1 | NM_213560 | up |
| 2761 | chr19 | PKN1 | NM_213560 | up |
| 2762 | chr19 | SYDE1 | NM_033025 | Down |
| 2763 | chr19 | ILVBL | NM_006844 | up |
| 2764 | chr19 | NOTCH3 | NM_000435 | Down |
| 2765 | chr19 | AKAP8L | NM_014371 | up |
| 2766 | chr19 | RASAL3 | NM_022904 | Down |
| 2767 | chr19 | CYP4F22 | NM_173483 | Down |
| 2768 | chr19 | CHERP | NM_006387 | up |
| 2769 | chr19 | CPAMD8 | NM_015692 | Down |
| 2770 | chr19 | USHBP1 | NM_031941 | Down |
| 2771 | chr19 | FAM129C | NM_173544 | Down |
| 2772 | chr19 | FCHO1 | NM_001161357 | up |
| 2773 | chr19 | KCNN1 | NM_002248 | up |
| 2774 | chr19 | PDE4C | NM_000923 | Down |
| 2775 | chr19 | LRRC25 | NM_145256 | Down |
| 2776 | chr19 | --- | --- | Down |
| 2777 | chr19 | C19orf60 | NM_001100418 | up |
| 2778 | chr19 | COMP | NM_000095 | up |
| 2779 | chr19 | GDF1 | NM_001492 | up |
| 2780 | chr19 | ARMC6 | NM_033415 | Down |
| 2781 | chr19 | SF4 | NM_172231 | Down |
| 2782 | chr19 | GATAD2A | NM_017660 | up |
| 2783 | chr19 | PBX4 | NM_025245 | Down |
| 2784 | chr19 | ZNF254 | NM_203282 | up |
| 2785 | chr19 | C19orf2 | NM_003796 | up |
| 2786 | chr19 | SLC7A9 | NM_014270 | Down |
| 2787 | chr19 | RHPN2 | NM_033103 | up |
| 2788 | chr19 | GPI | NM_000175 | up |
| 2789 | chr19 | --- | --- | Down |
| 2790 | chr19 | GRAMD1A | NM_020895 | up |
| 2791 | chr19 | FXYD5 | NR_028406 | Down |
| 2792 | chr19 | FXYD5 | NR_028406 | up |
| 2793 | chr19 | USF2 | NM_003367 | Down |

Fig. 2A-64

| | | | | |
|---|---|---|---|---|
| 2794 | chr19 | ATP4A | NM_000704 | up |
| 2795 | chr19 | HAUS5 | NM_015302 | up |
| 2796 | chr19 | RBM42 | NM_024321 | Down |
| 2797 | chr19 | ZBTB32 | NM_014383 | up |
| 2798 | chr19 | MLL4 | NM_014727 | up |
| 2799 | chr19 | U2AF1L4 | NM_001040425 | up |
| 2800 | chr19 | U2AF1L4 | NM_001040425 | up |
| 2801 | chr19 | LIN37 | NM_019104 | Down |
| 2802 | chr19 | C19orf55 | BC110893 | up |
| 2803 | chr19 | PRODH2 | NM_021232 | up |
| 2804 | chr19 | APLP1 | NM_001024807 | Down |
| 2805 | chr19 | COX7A1 | NM_001864 | up |
| 2806 | chr19 | ZNF568 | NM_198539 | Down |
| 2807 | chr19 | ZNF585A | NM_152655 | Down |
| 2808 | chr19 | DPF1 | NM_004647 | Down |
| 2809 | chr19 | RASGRP4 | NM_170604 | up |
| 2810 | chr19 | RASGRP4 | NM_170604 | Down |
| 2811 | chr19 | RYR1 | NM_000540 | Down |
| 2812 | chr19 | RYR1 | NM_000540 | Down |
| 2813 | chr19 | RYR1 | NM_000540 | up |
| 2814 | chr19 | MAP4K1 | NM_001042600 | up |
| 2815 | chr19 | ACTN4 | NM_004924 | Down |
| 2816 | chr19 | CAPN12 | NM_144691 | up |
| 2817 | chr19 | CAPN12 | NM_144691 | up |
| 2818 | chr19 | LGALS4 | NM_006149 | up |
| 2819 | chr19 | ECH1 | NM_001398 | Down |
| 2820 | chr19 | FBXO27 | NM_178820 | up |
| 2821 | chr19 | FCGBP | NM_003890 | Down |
| 2822 | chr19 | ZNF546 | NM_178544 | Down |
| 2823 | chr19 | MAP3K10 | NM_002446 | Down |
| 2824 | chr19 | AKT2 | NM_001626 | up |
| 2825 | chr19 | PLD3 | NM_001031696 | Down |
| 2826 | chr19 | PRX | NM_020956 | Down |
| 2827 | chr19 | BLVRB | NM_000713 | Down |
| 2828 | chr19 | SPTBN4 | NM_020971 | Down |
| 2829 | chr19 | LTBP4 | NM_001042544 | Down |
| 2830 | chr19 | ADCK4 | NM_024876 | up |
| 2831 | chr19 | C19orf54 | NM_198476 | up |
| 2832 | chr19 | CYP2B7P1 | NR_001278 | up |
| 2833 | chr19 | CYP2S1 | NM_030622 | up |
| 2834 | chr19 | --- | --- | up |
| 2835 | chr19 | AXL | NM_021913 | up |
| 2836 | chr19 | TMEM91 | NM_001098821 | up |
| 2837 | chr19 | EXOSC5 | NM_020158 | Down |

Fig. 2A-65

| | | | | |
|---|---|---|---|---|
| 2838 | chr19 | ATP5SL | NR_030765 | Down |
| 2839 | chr19 | CEACAM5 | NM_004363 | up |
| 2840 | chr19 | CEACAM3 | D90278 | Down |
| 2841 | chr19 | ARHGEF1 | NM_199002 | Down |
| 2842 | chr19 | GRIK5 | NM_002088 | up |
| 2843 | chr19 | MEGF8 | NM_001410 | Down |
| 2844 | chr19 | XRCC1 | NM_006297 | up |
| 2845 | chr19 | CADM4 | NM_145296 | Down |
| 2846 | chr19 | CADM4 | NM_145296 | Down |
| 2847 | chr19 | ZNF45 | NM_003425 | up |
| 2848 | chr19 | ZNF223 | NM_013361 | Down |
| 2849 | chr19 | CEACAM19 | NM_001127893 | Down |
| 2850 | chr19 | APOE | NM_000041 | up |
| 2851 | chr19 | NKPD1 | ENST00000317951 | Down |
| 2852 | chr19 | MARK4 | NM_031417 | Down |
| 2853 | chr19 | PPP1R13L | NM_001142502 | up |
| 2854 | chr19 | PPP1R13L | NM_001142502 | Down |
| 2855 | chr19 | OPA3 | NM_001017989 | up |
| 2856 | chr19 | EML2 | NM_012155 | up |
| 2857 | chr19 | QPCTL | NM_017659 | Down |
| 2858 | chr19 | SIX5 | NM_175875 | Down |
| 2859 | chr19 | FOXA3 | NM_004497 | Down |
| 2860 | chr19 | IRF2BP1 | NM_015649 | Down |
| 2861 | chr19 | HIF3A | AK299699 | Down |
| 2862 | chr19 | CCDC8 | NM_032040 | Down |
| 2863 | chr19 | PRKD2 | NM_016457 | up |
| 2864 | chr19 | STRN4 | NM_013403 | Down |
| 2865 | chr19 | BBC3 | NM_001127240 | Down |
| 2866 | chr19 | CCDC9 | NM_015603 | Down |
| 2867 | chr19 | CCDC9 | NM_015603 | Down |
| 2868 | chr19 | PRR24 | NM_178511 | up |
| 2869 | chr19 | DHX34 | NM_014681 | Down |
| 2870 | chr19 | DHX34 | D50924 | up |
| 2871 | chr19 | NAPA | NM_003827 | up |
| 2872 | chr19 | GLTSCR1 | NM_015711 | up |
| 2873 | chr19 | LIG1 | NM_000234 | up |
| 2874 | chr19 | CCDC114 | NM_144577 | up |
| 2875 | chr19 | CYTH2 | NM_017457 | up |
| 2876 | chr19 | CYTH2 | NM_017457 | up |
| 2877 | chr19 | SULT2B1 | NM_004605 | up |
| 2878 | chr19 | SPHK2 | NM_020126 | up |
| 2879 | chr19 | FUT2 | NM_000511 | up |
| 2880 | chr19 | PLEKHA4 | NM_020904 | Down |
| 2881 | chr19 | PLEKHA4 | NM_020904 | up |

Fig. 2A-66

| | | | | |
|---|---|---|---|---|
| 2882 | chr19 | RUVBL2 | NM_006666 | Down |
| 2883 | chr19 | DKKL1 | NM_014419 | Down |
| 2884 | chr19 | ALDH16A1 | NM_153329 | up |
| 2885 | chr19 | RCN3 | NM_020650 | up |
| 2886 | chr19 | SCAF1 | NM_021228 | Down |
| 2887 | chr19 | SCAF1 | NM_021228 | up |
| 2888 | chr19 | CPT1C | NM_152359 | up |
| 2889 | chr19 | PTOV1 | NM_017432 | Down |
| 2890 | chr19 | PNKP | NM_007254 | Down |
| 2891 | chr19 | AKT1S1 | NM_032375 | up |
| 2892 | chr19 | TBC1D17 | NM_024682 | Down |
| 2893 | chr19 | MYH14 | NM_001077186 | up |
| 2894 | chr19 | POLD1 | NM_002691 | Down |
| 2895 | chr19 | POLD1 | NM_002691 | Down |
| 2896 | chr19 | SYT3 | NM_032298 | Down |
| 2897 | chr19 | SHANK1 | NM_016148 | up |
| 2898 | chr19 | SHANK1 | NM_016148 | Down |
| 2899 | chr19 | SHANK1 | NM_016148 | up |
| 2900 | chr19 | KLK1 | NM_002257 | Down |
| 2901 | chr19 | KLK12 | NM_019598 | Down |
| 2902 | chr19 | CD33 | NM_001772 | Down |
| 2903 | chr19 | SIGLEC12 | NM_053003 | up |
| 2904 | chr19 | ZNF701 | NM_001172655 | Down |
| 2905 | chr19 | ZNF702P | NR_003578 | Down |
| 2906 | chr19 | PRKCG | NM_002739 | Down |
| 2907 | chr19 | TMC4 | NM_001145303 | up |
| 2908 | chr19 | TSEN34 | NM_024075 | Down |
| 2909 | chr19 | LILRA5 | NM_021250 | Down |
| 2910 | chr19 | TTYH1 | NM_020659 | Down |
| 2911 | chr19 | CDC42EP5 | NM_145057 | up |
| 2912 | chr19 | LILRB4 | NM_006847 | up |
| 2913 | chr19 | NCR1 | NM_004829 | up |
| 2914 | chr19 | GP6 | NM_001083899 | Down |
| 2915 | chr19 | RDH13 | NM_001145971 | up |
| 2916 | chr19 | C19orf51 | NM_178837 | up |
| 2917 | chr19 | PTPRH | NM_002842 | up |
| 2918 | chr19 | BRSK1 | NM_032430 | Down |
| 2919 | chr19 | SUV420H2 | NM_032701 | up |
| 2920 | chr19 | COX6B2 | NM_144613 | up |
| 2921 | chr19 | SHISA7 | NM_001145176 | up |
| 2922 | chr19 | U2AF2 | NM_007279 | up |
| 2923 | chr19 | ZNF551 | NM_138347 | Down |
| 2924 | chr19 | ZNF154 | NM_001085384 | Down |
| 2925 | chr19 | ZSCAN18 | NM_001145542 | Down |

Fig. 2A-67

| | | | | |
|---|---|---|---|---|
| 2926 | chr19 | ZNF274 | NM_016325 | Down |
| 2927 | chr19 | ZNF274 | NM_016325 | Down |
| 2928 | chr19 | ZNF8 | NM_021089 | Down |
| 2929 | chr19 | ZNF446 | NM_017908 | up |
| 2930 | chr19 | ZNF446 | NM_017908 | Down |
| 2931 | chr20 | C20orf96 | NM_153269 | up |
| 2932 | chr20 | NRSN2 | NM_024958 | up |
| 2933 | chr20 | SDCBP2 | NM_080489 | Down |
| 2934 | chr20 | SDCBP2 | NM_080489 | up |
| 2935 | chr20 | TGM6 | NM_198994 | Down |
| 2936 | chr20 | SNRPB | NM_198216 | Down |
| 2937 | chr20 | IDH3B | NM_006899 | up |
| 2938 | chr20 | OXT | NM_000915 | Down |
| 2939 | chr20 | HSPA12B | NM_052970 | Down |
| 2940 | chr20 | ADRA1D | NM_000678 | up |
| 2941 | chr20 | RASSF2 | NM_014737 | Down |
| 2942 | chr20 | RASSF2 | NM_014737 | Down |
| 2943 | chr20 | C20orf7 | NM_024120 | up |
| 2944 | chr20 | PCSK2 | NM_002594 | up |
| 2945 | chr20 | MGC44328 | BC033985 | up |
| 2946 | chr20 | C20orf12 | NM_001099407 | up |
| 2947 | chr20 | SEC23B | NM_006363 | Down |
| 2948 | chr20 | SLC24A3 | NM_020689 | Down |
| 2949 | chr20 | RIN2 | NM_018993 | up |
| 2950 | chr20 | CRNKL1 | NM_016652 | up |
| 2951 | chr20 | NKX2-2 | NM_002509 | Down |
| 2952 | chr20 | CST8 | NM_005492 | Down |
| 2953 | chr20 | PYGB | NM_002862 | up |
| 2954 | chr20 | ABHD12 | NM_001042472 | up |
| 2955 | chr20 | GINS1 | AK294593 | Down |
| 2956 | chr20 | NINL | NM_025176 | up |
| 2957 | chr20 | HM13 | NM_030789 | Down |
| 2958 | chr20 | HM13 | NM_178580 | up |
| 2959 | chr20 | DUSP15 | NM_080611 | up |
| 2960 | chr20 | TSPYL3 | NR_002781 | up |
| 2961 | chr20 | DNMT3B | NM_006892 | up |
| 2962 | chr20 | BPIL1 | NM_025227 | up |
| 2963 | chr20 | BPIL3 | NM_174897 | Down |
| 2964 | chr20 | BASE | NR_026760 | Down |
| 2965 | chr20 | NECAB3 | NM_031231 | Down |
| 2966 | chr20 | AHCY | NM_000687 | up |
| 2967 | chr20 | CEP250 | NM_007186 | up |
| 2968 | chr20 | CEP250 | NM_007186 | Down |
| 2969 | chr20 | EPB41L1 | NM_012156 | up |

Fig. 2A-68

| | | | | |
|---|---|---|---|---|
| 2970 | chr20 | EPB41L1 | NM_012156 | Down |
| 2971 | chr20 | DLGAP4 | NM_014902 | Down |
| 2972 | chr20 | MYL9 | NM_006097 | Down |
| 2973 | chr20 | SLA2 | NM_032214 | Down |
| 2974 | chr20 | SLA2 | NM_032214 | Down |
| 2975 | chr20 | C20orf117 | NM_080627 | Down |
| 2976 | chr20 | VSTM2L | NM_080607 | up |
| 2977 | chr20 | TGM2 | NM_004613 | Down |
| 2978 | chr20 | PLCG1 | NM_002660 | Down |
| 2979 | chr20 | PLCG1 | NM_002660 | up |
| 2980 | chr20 | ZHX3 | NM_015035 | Down |
| 2981 | chr20 | PTPRT | NM_133170 | up |
| 2982 | chr20 | PTPRT | NM_133170 | Down |
| 2983 | chr20 | SGK2 | NM_016276 | up |
| 2984 | chr20 | WISP2 | NM_003881 | up |
| 2985 | chr20 | PI3 | NM_002638 | Down |
| 2986 | chr20 | SEMG1 | NM_003007 | Down |
| 2987 | chr20 | SNX21 | AF258570 | Down |
| 2988 | chr20 | PCIF1 | NM_022104 | up |
| 2989 | chr20 | ZNF335 | NM_022095 | Down |
| 2990 | chr20 | CDH22 | NM_021248 | Down |
| 2991 | chr20 | SLC35C2 | NM_173179 | Down |
| 2992 | chr20 | EYA2 | NM_005244 | Down |
| 2993 | chr20 | STAU1 | NM_017454 | Down |
| 2994 | chr20 | B4GALT5 | NM_004776 | up |
| 2995 | chr20 | TMEM189 | NM_199129 | Down |
| 2996 | chr20 | DOK5 | NM_018431 | up |
| 2997 | chr20 | PMEPA1 | NM_020182 | up |
| 2998 | chr20 | PMEPA1 | NM_199171 | up |
| 2999 | chr20 | ANKRD60 | ENST00000457363 | Down |
| 3000 | chr20 | STX16 | NM_001001433 | up |
| 3001 | chr20 | NPEPL1 | NM_024663 | up |
| 3002 | chr20 | NPEPL1 | NM_024663 | Down |
| 3003 | chr20 | TH1L | NM_198976 | Down |
| 3004 | chr20 | CDH26 | NM_177980 | up |
| 3005 | chr20 | CDH4 | NM_001794 | Down |
| 3006 | chr20 | SS18L1 | NM_198935 | up |
| 3007 | chr20 | LAMA5 | NM_005560 | Down |
| 3008 | chr20 | LAMA5 | NM_005560 | Down |
| 3009 | chr20 | LAMA5 | NM_005560 | Down |
| 3010 | chr20 | LAMA5 | NM_005560 | Down |
| 3011 | chr20 | SLC17A9 | NM_022082 | up |
| 3012 | chr20 | COL20A1 | NM_020882 | Down |
| 3013 | chr20 | KCNQ2 | NM_172107 | Down |

Fig. 2A-69

| | | | | |
|---|---|---|---|---|
| 3014 | chr20 | KCNQ2 | NM_172107 | Down |
| 3015 | chr20 | PRIC285 | NM_001037335 | Down |
| 3016 | chr20 | GMEB2 | NM_012384 | up |
| 3017 | chr20 | RTEL1 | NM_016434 | up |
| 3018 | chr20 | RTEL1 | NM_016434 | Down |
| 3019 | chr20 | RTEL1 | NM_016434 | Down |
| 3020 | chr20 | RTEL1 | NM_032957 | up |
| 3021 | chr20 | ZGPAT | NM_032527 | Down |
| 3022 | chr20 | SLC2A4RG | NM_020062 | Down |
| 3023 | chr20 | DNAJC5 | NM_025219 | Down |
| 3024 | chr20 | UCKL1 | BC033078 | Down |
| 3025 | chr20 | ZNF512B | NM_020713 | up |
| 3026 | chr20 | C20orf201 | BC036837 | Down |
| 3027 | chr20 | MYT1 | NM_004535 | up |
| 3028 | chr21 | CXADR | NM_001338 | Down |
| 3029 | chr21 | TMPRSS15 | NM_002772 | up |
| 3030 | chr21 | ADAMTS5 | NM_007038 | Down |
| 3031 | chr21 | C21orf7 | NM_020152 | up |
| 3032 | chr21 | C21orf7 | NM_020152 | Down |
| 3033 | chr21 | KRTAP19-3 | NM_181609 | up |
| 3034 | chr21 | KRTAP6-1 | NM_181602 | Down |
| 3035 | chr21 | OLIG2 | NM_005806 | up |
| 3036 | chr21 | IL10RB | NM_000628 | Down |
| 3037 | chr21 | SETD4 | NM_017438 | Down |
| 3038 | chr21 | CBR3 | NM_001236 | up |
| 3039 | chr21 | MORC3 | NM_015358 | Down |
| 3040 | chr21 | KCNJ6 | NM_002240 | up |
| 3041 | chr21 | ERG | NM_004449 | Down |
| 3042 | chr21 | C21orf129 | NR_027272 | up |
| 3043 | chr21 | PRDM15 | NM_022115 | Down |
| 3044 | chr21 | ABCG1 | NM_016818 | Down |
| 3045 | chr21 | ABCG1 | NM_016818 | up |
| 3046 | chr21 | TFF3 | NM_003226 | Down |
| 3047 | chr21 | TFF2 | NM_005423 | Down |
| 3048 | chr21 | RRP1 | NM_003683 | Down |
| 3049 | chr21 | PWP2 | NM_005049 | Down |
| 3050 | chr21 | C21orf33 | NM_004649 | Down |
| 3051 | chr21 | ICOSLG | NM_015259 | up |
| 3052 | chr21 | DNMT3L | NM_013369 | up |
| 3053 | chr21 | AIRE | NM_000383 | up |
| 3054 | chr21 | PFKL | NR_024108 | Down |
| 3055 | chr21 | PFKL | NR_024108 | Down |
| 3056 | chr21 | C21orf2 | NM_004928 | up |
| 3057 | chr21 | TRPM2 | NM_003307 | Down |

Fig. 2A-70

| | | | | |
|---|---|---|---|---|
| 3058 | chr21 | POFUT2 | NM_015227 | Down |
| 3059 | chr21 | SLC19A1 | NM_194255 | Down |
| 3060 | chr21 | SLC19A1 | NM_194255 | up |
| 3061 | chr21 | PCBP3 | NM_020528 | Down |
| 3062 | chr21 | COL6A1 | NM_001848 | Down |
| 3063 | chr21 | COL6A2 | NM_001849 | Down |
| 3064 | chr21 | PCNT | NM_006031 | Down |
| 3065 | chr21 | DIP2A | NM_015151 | up |
| 3066 | chr22 | CECR1 | CR456417 | Down |
| 3067 | chr22 | BCL2L13 | NM_015367 | up |
| 3068 | chr22 | PRODH | NM_016335 | Down |
| 3069 | chr22 | 5-Sep | NM_002688 | up |
| 3070 | chr22 | GNB1L | NM_053004 | Down |
| 3071 | chr22 | GNB1L | NM_053004 | up |
| 3072 | chr22 | ARVCF | NM_001670 | up |
| 3073 | chr22 | C22orf25 | NM_152906 | up |
| 3074 | chr22 | DGCR8 | NM_022720 | Down |
| 3075 | chr22 | ZDHHC8 | NM_013373 | Down |
| 3076 | chr22 | THAP7 | NM_030573 | Down |
| 3077 | chr22 | PPM1F | NM_014634 | Down |
| 3078 | chr22 | ZNF280B | NM_080764 | up |
| 3079 | chr22 | ZNF280B | NM_080764 | Down |
| 3080 | chr22 | IGLV2-23 | ENST00000390306 | Down |
| 3081 | chr22 | GNAZ | NM_002073 | up |
| 3082 | chr22 | FBXW4P1 | NR_033408 | Down |
| 3083 | chr22 | VPREB3 | NM_013378 | up |
| 3084 | chr22 | SLC2A11 | NM_030807 | Down |
| 3085 | chr22 | GSTT1 | NM_000853 | Down |
| 3086 | chr22 | CABIN1 | NM_012295 | Down |
| 3087 | chr22 | CABIN1 | NM_012295 | Down |
| 3088 | chr22 | C22orf36 | ENST00000446942 | Down |
| 3089 | chr22 | CRYBB3 | NM_004076 | Down |
| 3090 | chr22 | LRP5L | NM_182492 | Down |
| 3091 | chr22 | MYO18B | NM_032608 | up |
| 3092 | chr22 | SEZ6L | NM_021115 | up |
| 3093 | chr22 | HPS4 | NM_022081 | Down |
| 3094 | chr22 | HPS4 | NM_022081 | up |
| 3095 | chr22 | TFIP11 | NM_001008697 | Down |
| 3096 | chr22 | MN1 | NM_002430 | Down |
| 3097 | chr22 | RASL10A | NM_006477 | up |
| 3098 | chr22 | ASCC2 | NM_032204 | Down |
| 3099 | chr22 | GAL3ST1 | NM_004861 | Down |
| 3100 | chr22 | FLJ20464 | CR456348 | Down |
| 3101 | chr22 | SFI1 | ENST00000433295 | Down |

Fig. 2A-71

| | | | | |
|---|---|---|---|---|
| 3102 | chr22 | DEPDC5 | NM_014662 | Down |
| 3103 | chr22 | C22orf24 | AK294232 | Down |
| 3104 | chr22 | --- | --- | Down |
| 3105 | chr22 | RBM9 | NM_001031695 | Down |
| 3106 | chr22 | EIF3D | NM_003753 | up |
| 3107 | chr22 | --- | --- | up |
| 3108 | chr22 | --- | --- | up |
| 3109 | chr22 | --- | --- | Down |
| 3110 | chr22 | CSF2RB | NM_000395 | up |
| 3111 | chr22 | CSF2RB | NM_000395 | up |
| 3112 | chr22 | C1QTNF6 | NM_031910 | Down |
| 3113 | chr22 | CARD10 | NM_014550 | Down |
| 3114 | chr22 | GGA1 | NM_013365 | Down |
| 3115 | chr22 | TRIOBP | NM_138632 | up |
| 3116 | chr22 | TRIOBP | NM_138632 | up |
| 3117 | chr22 | GALR3 | NM_003614 | up |
| 3118 | chr22 | PICK1 | NM_012407 | up |
| 3119 | chr22 | CSNK1E | NM_152221 | up |
| 3120 | chr22 | SUN2 | NM_015374 | Down |
| 3121 | chr22 | CACNA1I | NM_021096 | up |
| 3122 | chr22 | TNRC6B | NM_001162501 | up |
| 3123 | chr22 | TNRC6B | NM_001162501 | Down |
| 3124 | chr22 | ADSL | NM_000026 | Down |
| 3125 | chr22 | SGSM3 | NM_015705 | Down |
| 3126 | chr22 | XPNPEP3 | NM_022098 | Down |
| 3127 | chr22 | C22orf46 | NM_001142964 | up |
| 3128 | chr22 | 3-Sep | NM_145733 | up |
| 3129 | chr22 | WBP2NL | NM_152613 | up |
| 3130 | chr22 | NFAM1 | NM_145912 | up |
| 3131 | chr22 | PACSIN2 | NM_007229 | Down |
| 3132 | chr22 | SCUBE1 | NM_173050 | up |
| 3133 | chr22 | SCUBE1 | NM_173050 | Down |
| 3134 | chr22 | LDOC1L | NM_032287 | Down |
| 3135 | chr22 | SMC1B | NM_148674 | up |
| 3136 | chr22 | PPARA | NM_005036 | Down |
| 3137 | chr22 | PPARA | NM_001001928 | Down |
| 3138 | chr22 | CELSR1 | NM_014246 | up |
| 3139 | chr22 | BRD1 | NM_014577 | up |
| 3140 | chr22 | ALG12 | NM_024105 | Down |
| 3141 | chr22 | MOV10L1 | NM_018995 | Down |
| 3142 | chr22 | TRABD | NM_025204 | Down |
| 3143 | chr22 | SELO | NM_031454 | up |
| 3144 | chr22 | SELO | NM_031454 | up |
| 3145 | chr22 | SBF1 | NM_002972 | Down |

Fig. 2A-72

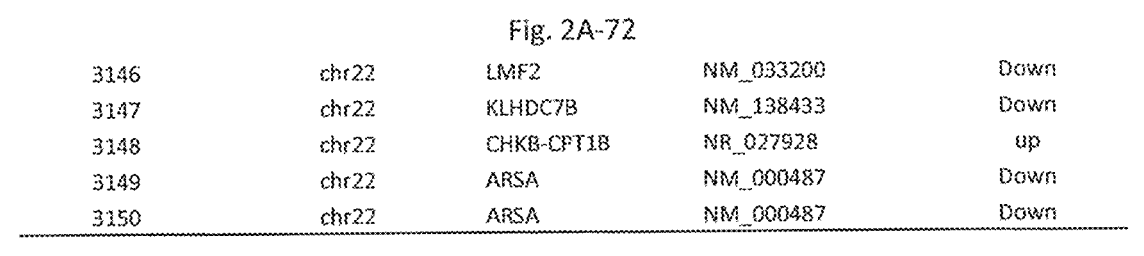

| | | | | |
|---|---|---|---|---|
| 3146 | chr22 | LMF2 | NM_033200 | Down |
| 3147 | chr22 | KLHDC7B | NM_138433 | Down |
| 3148 | chr22 | CHKB-CPT1B | NR_027928 | up |
| 3149 | chr22 | ARSA | NM_000487 | Down |
| 3150 | chr22 | ARSA | NM_000487 | Down |

Fig. 2B-1

Comprehensive Description of Non-coding Small RNA T21 Biomarkers

| Biomarker ID | Chromosome location | Gene Symbol | Sequence Type | Fold-Change |
|---|---|---|---|---|
| 3151 | chr1 | ENSG00000201898 | snoRNA | Up |
| 3152 | chr1 | hsa-mir-181b-1 // hsa-mir-181b-2 | miRNA | Up |
| 3153 | chr1 | U44 | CDBox | Up |
| 3154 | chr1 | ACA16 | HAcaBox | Up |
| 3155 | chr1 | hsa-mir-186 | miRNA | Down |
| 3156 | chr1 | ACA26 | scaRna | Down |
| 3157 | chr1 | ENSG00000201791 | snoRNA | Down |
| 3158 | chr2 | hsa-mir-933 | miRNA | Up |
| 3159 | chr2 | ENSG00000212581 | snoRNA | Up |
| 3160 | chr2 | hsa-mir-216b | miRNA | Down |
| 3161 | chr2 | hsa-mir-26b | miRNA | Down |
| 3162 | chr3 | ACA4 | HAcaBox | Up |
| 3163 | chr3 | hsa-mir-569 | miRNA | Down |
| 3164 | chr3 | hsa-mir-944 | miRNA | Down |
| 3165 | chr3 | hsa-mir-548i-1 // hsa-mir-548i-2 // hsa-mir- | miRNA | Down |
| 3166 | chr3 | hsa-mir-568 | miRNA | Down |
| 3167 | chr3 | hsa-mir-567 | miRNA | Down |
| 3168 | chr4 | ACA11 | HAcaBox | Down |
| 3169 | chr4 | ENSG00000202440 | snoRNA | Down |
| 3170 | chr5 | ENSG00000212363 | snoRNA | Up |
| 3171 | chr5 | ENSG00000201551 | snoRNA | Up |
| 3172 | chr5 | U95 | CDBox | Up |
| 3173 | chr5 | hsa-mir-581 | miRNA | Down |
| 3174 | chr5 | hsa-mir-548p | miRNA | Down |
| 3175 | chr5 | U19-2 | HAcaBox | Down |
| 3176 | chr6 | ACA33 | HAcaBox | Up |
| 3177 | chr6 | hsa-mir-877 | miRNA | Down |
| 3178 | chr7 | hsa-mir-335 | miRNA | Up |
| 3179 | chr7 | hsa-mir-591 | miRNA | Up |
| 3180 | chr7 | hsa-mir-550-1 // hsa-mir-550-2 | miRNA | Down |
| 3181 | chr7 | hsa-mir-93 | miRNA | Down |
| 3182 | chr7 | ENSG00000207217 | snoRNA | Down |
| 3183 | chr8 | ENSG00000212342 | snoRNA | Up |
| 3184 | chr8 | HBII-276 | CDBox | Up |
| 3185 | chr8 | ENSG00000206853 | snoRNA | Up |
| 3186 | chr8 | hsa-mir-151 | miRNA | Up |
| 3187 | chr8 | hsa-mir-937 | miRNA | Down |
| 3188 | chr8 | hsa-mir-30d | miRNA | Down |
| 3189 | chr9 | hsa-let-7d | miRNA | Up |
| 3190 | chr9 | hsa-mir-31 | miRNA | Down |
| 3191 | chr10 | U108 | HAcaBox | Up |
| 3192 | chr10 | ACA19 | HAcaBox | Up |
| 3193 | chr10 | hsa-mir-607 | miRNA | Down |
| 3194 | chr11 | hsa-mir-548l | miRNA | Up |
| 3195 | chr11 | ENSG00000201980 | snoRNA | Up |
| 3196 | chr11 | U99 | HAcaBox | Up |
| 3197 | chr11 | ENSG00000212277 | snoRNA | Up |
| 3198 | chr11 | ENSG00000206976 | snoRNA | Up |
| 3199 | chr11 | ACA54 | HAcaBox | Up |
| 3200 | chr11 | mgh28S-2409 | CDBox | Up |

Fig. 2B-2

| | | | | |
|---|---|---|---|---|
| 3201 | chr11 | hsa-mir-129-2 // hsa-mir-129-1 | miRNA | Down |
| 3202 | chr11 | ENSG00000212551 | snoRNA | Down |
| 3203 | chr11 | U28 | CDBox | Down |
| 3204 | chr12 | hsa-mir-331 | miRNA | Up |
| 3205 | chr12 | hsa-mir-148b | miRNA | Up |
| 3206 | chr12 | hsa-mir-148b | miRNA | Down |
| 3207 | chr13 | ENSG00000199282 | snoRNA | Up |
| 3208 | chr13 | ACA27 | HAcaBox | Up |
| 3209 | chr14 | hsa-mir-654 | miRNA | Up |
| 3210 | chr14 | hsa-mir-541 | miRNA | Up |
| 3211 | chr14 | U93 | scaRna | Up |
| 3212 | chr14 | hsa-mir-543 | miRNA | Down |
| 3213 | chr14 | hsa-mir-432 | miRNA | Down |
| 3214 | chr14 | hsa-mir-376a-2 // hsa-mir-376a-1 | miRNA | Down |
| 3215 | chr14 | hsa-mir-493 | miRNA | Down |
| 3216 | chr14 | 14q(II-4) | CDBox | Down |
| 3217 | chr15 | ENSG00000199633 | snoRNA | Up |
| 3218 | chr15 | HBII-52-5 | CDBox | Up |
| 3219 | chr15 | HBII-85-3 | CDBox | Up |
| 3220 | chr15 | HBII-52-41 | CDBox | Up |
| 3221 | chr15 | HBII-85-4 | CDBox | Down |
| 3222 | chr15 | HBII-438A | CDBox | Down |
| 3223 | chr15 | ENSG00000212604 | snoRNA | Down |
| 3224 | chr15 | ENSG00000212528 | snoRNA | Down |
| 3225 | chr15 | HBII-52-21 | CDBox | Down |
| 3226 | chr17 | hsa-mir-22 | miRNA | Up |
| 3227 | chr17 | U49B | CDBox | Up |
| 3228 | chr17 | hsa-mir-1253 | miRNA | Down |
| 3229 | chr18 | ENSG00000199856 | snoRNA | Down |
| 3230 | chr18 | ENSG00000199856 | snoRNA | Down |
| 3231 | chr19 | hsa-mir-99b | miRNA | Up |
| 3232 | chr19 | hsa-mir-520c | miRNA | Down |
| 3233 | chr19 | hsa-mir-523 | miRNA | Down |
| 3234 | chr19 | hsa-mir-516a-1 // hsa-mir-516a-2 | miRNA | Down |
| 3235 | chr19 | U105 | CDBox | Down |
| 3236 | chr20 | hsa-mir-499 | miRNA | Up |
| 3237 | chr20 | U71b | HAcaBox | Up |
| 3238 | chr21 | ENSG00000207147 | snoRNA | Up |
| 3239 | chr22 | hsa-mir-1286 | miRNA | Up |
| 3240 | chr22 | hsa-mir-185 | miRNA | Up |
| 3241 | chr22 | ENSG00000199783 | snoRNA | Up |
| 3242 | chrX | hsa-mir-548m | miRNA | Up |
| 3243 | chrX | ENSG00000202231 | snoRNA | Up |
| 3244 | chrX | ENSG00000200620 | snoRNA | Up |
| 3245 | chrX | hsa-mir-98 | miRNA | Down |
| 3246 | chrX | hsa-mir-450b | miRNA | Down |
| 3247 | chrX | hsa-mir-505 | miRNA | Down |
| 3248 | chrX | hsa-mir-1277 | miRNA | Down |

Figure 3-1

8. chr1_LMNA_NM_170707_-1.58997
CCATGGGCAATTGGCAGATCAAGCGCCAGAATGGAGATGATCCCTTGCTG
ACTTACCGGTTCCCACCAAA 9. chr1_PLEKHN1_NM_032129_-1.66714
AGTGGGACCGGCTCTTGGTCCTGTACCCAACGTCCTTGGCCATTTTCTCC
GAGGAGCTGGACGGGCTTTGCTTCAA 10. chr1_B3GALT6_NM_080605_-1.56537
GGGCGGCGCTAGGCCTGGGCACGCTGGCGCTGTGCGGGGCGGCGCTGCTC
TACCTGGCGCGCTGCGCGGCCGAGCCCGGGGACCCCAGGGCGATGTCGGG
CCGCAGCCCGCCTCC 11. chr1_ACAP3_NM_030649_-1.55419
TGGATACACCTGCGGAACTGGAGCTCCGTGGGGCTGCCCGCCAGGGCGCC
CGGGGGACCAGGGGCAGCCTCGGCCTCGCGCATTTCCTCCGCCATGCGCG
CCAGAC 12. chr1_CPSF3L_NM_017871_1.7052
CAGTCCAGGAAGTCTGTTAGGCGGCCGTTCTGGGTGATGTAGGAGA 13. chr1_---_---_-2.08221
GATGGGCCACTCGGAGGGGGGCTCAC 14. chr1_FLJ14100_AK024162_-1.67072
CAGCGCCAGCGTGTAGCCTCCTCCCAGGATCCGGAGCAGGAGGGTGGCTG
TCTTTTGCGTTCAATCCGCTGGGCTGC 15. chr1_MORN1_NM_024848_2.10934
ATCTGTGAACTCGGCACAGCCCTGCT 16. chr1_LOC100129534_NR_024489_1.55634
CTCTGGGACTTTCGAGTCGGTTGGTGCACTTGCGGGGGCCCAGCAGGGGT
ACGTTCGTGACGGGCTATTTGGCAAAGACAGCCATTCTCCCCTTCTCCTC
CGGTAAGAGTCTTTGCCAGCACATTGCGCTTCTTGTCTCTGTGTGGCCTG
GTGTGGCCGGGCCGTGTAACCAAGCT 17. chr1_RER1_ENST00000434662_-1.51728
CTGTTTGCGGGGACGGTCGGTGCAGCTGCAAGGCTGGAGGCGGCCGGCAG
GTGCCCGGTGCTGGCTGCAGATGCGGCGCTAACCTTCTCTC 18. chr1_PANK4_NM_018216_1..75613
TATAGGTGATGGTGCGCATGGTCACGGGGTGGCCCCGGATAAAGAAGCCT
CCAAAGTACACGCGGTCCAGGCTGTGCAGCCGTGCGTGGAGGCAGGCCAG
CTGCCCAATGTCGTTGCTGATCATGTGCA 19. chr1_PANK4_NM_018216_1.62121
TTCGTTTTGGTGAGCAGAGCGCCAAGCCCCCAGAAGGTGCCGCCTCCAAT
GGAGCTGCCGCCGACCCACTCGAACCTGTCCTCCGTC 20. chr1_ARHGEF16_NM_014448_-1.65533
AGGACTACGCCCAGATGAACCACATCCAGGTGGAGAAGATAGAGCCGTCT
GAGCTCCCTCTGCCCGGGGGCGGCAACCGTAGCTCCTCCGTGCCCCACCC
CTTCCAGGTGACCCTGCTTCGCAACAG

Figure 3-2

21. chr1_WDR8_ENST00000378322_1.52292
CCCGTGTGATGCCAGACTGCACACAGCAAGGCTGCCACGTCCGTGGCCTC
GG 22. chr1_TP73_NM_005427_-1.85338
GCCGGTCCTCTCGCCCATGAACAAGGTGCACGGGGGCATGAACAAGCTGC
CCTCCGTCAACCAGCTGGTGGGCCAGCCTCCCCCGCACAGTTCGGCAGCT
ACACCCAACCTGGGG 23. chr1_DFFB_AB028912_-1.71896
GTGTCTTCTGCTGGACCGGCACCTTTTGTTTGTC 24. chr1_AJAP1_NM_018836_-1.75729
CCGTCTGCAGAGCGAGCGCTCAGACGGAGCCCCCGGGCAACTTGAGTGGC
GCCGATCGGCGGCGGAGCCTCTGGCAGAGCCCCCCGACCCGGCAGCGCGG
AGGGGACTCGCGTCCGTCCGCGTCGCGTCACCCCAAACCCTAAGCAGCGC
CGCCCCATCGGCGCGGAGCTCCGGCTGGAGGCAAGAGCCGCGCGCCGGGA
GACACGCACCGTGAGCGGCAGCGCCGCCGGCCTCCCTCCTCGCCGCCCCG
GAGGGCGAAGCCGCGGCTCCCCAGCCCTTTGCTGCGCCGCGACAG 25. chr1_NPHP4_NM_015102_-1.54678
TGGGTCTCACAGATGACGTTCGGGTCG 26. chr1_KCNAB2_NM_003636_1.55778
AATGAGGGAGTCAGCTCCGTGCTCCTGGGGGCCTCCAATGCGGACCAGCT
CATGGA 27. chr1_CHD5_NM_015557_-1.73201
CACACGCGGCAGAACTCCATGTGGTCGTCCTCCTCCTCGCAGCCGCC
CTCCTCCTCTTCATCGTCGTCGTCCTTCGGCTCCCAC 28. chr1_RNF207_NM_207396_-1.96391
GGTGCGGCACAGCGCCGCCGAGGAGGAGGACGCTATCCACGCCCTCTTCG
GCAGCATGCAG 29. chr1_PLEKHG5_NM_020631_-1.91465
ACAGGCCTCGCAGAGGTTGAGGGGCCCCCGGCGGTGCAGCTGCTGGCAGT
CGGCGTGGTGACATAC 30. chr1_ZBTB48_NM_005341_-1.52777
CGGCTCCTTCGTCCAGCACAGTGTGAGGGTTCTGCAGGAGCTCAACAAGC
AGCGGGAGAAGGGCCAGTACTGCGACGCCACTCTGGACGTGGGGGGCCTG
GTGTTTAAGGCACACTGGAGTGTCCTTGCCTGCTGCAGTCACTTTTTCCA
GAGCCTCTACGGGGATGGCTCAGGGGGCAGTGTCGTCCTCCCTGCTGGCT
TCGCTGAGATCTTTGGCCTCTTGTTGGACTTTTTCTACACTGGTCACCTC
GCTCTCACCTCAGGGAACCGGGATCAGGTGCTCCTGGCAGCCAGGGAGTT
GCGAGTGCCAGAGGCCGTAGAGCTGTGCCAGAGCTTCAAGCCCAAAACTT
CAGTGGGACAGGCAGCAGGTGGCCAGAGTGGGCTGGGGCCCCCTGCCTCC
CAGAATGTGAACAGCCACGTCAAGGAGCCGGCAGGCTTGGAAGAAGAGGA
AGTTTCGAGGACTCTGGGTCTAGTCCCCAGGGATCAGGAGCCCAGAGGCA
GTCATAGTCCTCAGAGGCCCCAGCTCCATTCCCCAGCTCAGAGTGAGGGC
CCCTCCTCCCTCTGTGGGAAACTGAAGCAGGCCTTGAAGCCTTGTCCCCT
TGAGGACAAGAAACCCGAGGACTG

Figure 3-3

31. chr1_KLHL21_NM_014851_1.61569
ACATGAGTCCGTTTAGAGTCGCAGTCTTGGGGGCGAAGGACCAGGGCGGG
AGCTGGCCGCAGTCCACCAGCGACCACAGGTCGGTGTCCGGGTCGTAGCA
CTGCATCACCATGGTCTCCTTGCCAGCCAGGGAGCCGATGGCATAGAGCC
GGCCACGGCACGCAGTGGTGGAGCAGTTGTCCATGGGGTAGGTCATGGGC
TGCAGGGCCTCCCAGGAGTCAGTGGTGTGGTCATAGCGCTCGGTGCTGTC
GGCGGCCACCACGTACAGCAGTCCGTCCAGCACAGAGGAGCTGTGGTACT
CGCGGGCCTTCAGCATGGGCGCCACCTCCGCCCACTCATTCACGCTTGAG
TTGTACCTCCACACGCAGTCATAGAGCCGGGAGCCAT 32. chr1_PHF13_NM_153812_-1.62492
CACTGCTGGTACCATTGACAGCGACGGCTGGGACGCGGGTTTCTCAGACA
TCGCGTCCTCAGTGCCCTTGCCAGTCTCTGACCGCTGCTTTAGCCAC 33. chr1_PHF13_NM_153812_-1.5109
GGCCCGTGTTCATAACTCAGTTTCCTGTTTTGCACGATGTAAAAACCCTG
TCTTTTTGCACGATACAGCCAAAAGTATTGGCTGATTTCTTGCTGAGTGC
CCTCTTAGTTGGTGTGTGAGGTCTTGGTGGGCTCAGGCCAGCTGTTTGCG
AGTGTGGGAACTCATAGGTTCTGTCTTTGTCTCTTCCTTTCACCTCATTC
TGGTAGCAGCATAAAGGTTAGGCAATCACTGGGACCCGCATGGTGTTCCT
CCAAAGAATAGGGTAAAGGAGAGCTGGGAGGGAGCCCTCTCCGTTGGGTG
ACTCTTGTGTGCCCTTTAGACAGGCTGGCCTGCCGGTTCCACAGGGTACA
GTTAGGACTTGAGTCTTTCTTTTTCTGTTTTGAGTTGGTGAGTGAGTGAT
AGGGTAACATGGGCCTTCAGGATGACCCCTTGGAACTGTGCCGAGTTCCT
TAAATCTCAGCTGGGATCCTGGACCTGGGAGGCCCCTGTGAGGGCCAGCT
CTGGAAAAACCTGGGAGTTGATGCCGGAGGCTGTGGAAGAACTCTGCTCG
AGGGCAGGGTGCCCTGGAACACTGGTAGTTCTGGGGCTGGGAGGGAGAGG
GGCTCCGGCTTTCTCTGAAATGAACACTGCTCTTCAGCAGTTCAAGTACT
TGTTCTCAAAACATTTTCTAATTGATTGGTAGGTTTTCATAAGCATTGTT
TCTTTAAGGCATGGAAAGGGAAGAATGCTCAAGCAAGTCATGTTTGTTTT
CAGTGGGATGGGCCCGCGTTCTCACTGCTGGGGGCTTCCCCTTCATGTGG
CACCTTTGTGCCAGGCCACCAGGCAGACTCTTCCCACCTTCTCCCACTGA
AGCACCAAGGGGCTTGAACCGTAATTTGGCTAATCAGAGGCATTTTTTTT
GTCCTAGTATCTTTCACACTTGTCCAACCGTCTTATTTTTTTAAAAGTTC
TGTTGCTTGTATTAACACGAAACTAGAGAGAAATAGTTTCTGAAGCCAGT
TTATTGTGAAGATCCCCAAGGGGGAGGTTCGGTAGAGAAAAATAGTAAGC
TGGTTTAGAAACTGACGAGGGCAAACAGCCAGGACGCATTGGAGAGGAAT
TTGCCAAAGATCTACCCTGAGATAACGCCTGTCCAGTGTCTTCACCACGT
GAATAACCAGCGCTCCAAAGTGTTTTTCTGCTTTGAAAAAAAAAAATTCC
ACAAGCTTTTAAAGGTGCATTTAAGAATCCATGTGACTTTAGAATGGAAC
TGCCGGCCCTGGCAACTGTCACGTGTGCTAGAAGGTTCGATGCCTCTGGA
ATGCATGTGATACTCATCTCCATTTTGTTTCCTTGATTGCATTTTTGTTC
TTTTAGCAGATCTGTCCCTGTGGGTGGTGTCTAAGAAGTCGGACACCTTG
GTTTTTGTGTTAGATTGAGCTGGGCAGCTGCAATCAGCTTCTTTATATGC
AAATTAGGCACGACCCATCTGTGGTTCCTGGTTGGTGGCTAATGAAGTGA
GGGGAGGGAGGGATGTCACCCCAAAAGTAGGCCCTCCCATTGGCTTTGGC 34. chr1_PER3_NM_016831_1.59364
GAGTCCAACTCTGGACCCACCCCCTTCAG 35. chr1_PARK7_NM_007262_-1.55663
AGTACAGTGTAGCCGTGATGTGGTCATTT 36. chr1_RERE_NM_012102_-1.81991
CCCTCTCCCGGCTTCAGAAAGATGCTGTGGTGGCTGTGATGCCACCGGCA

Figure 3-4

GAGAGCATGCTGGGGGGTCACACAAAGCAGGAGTTGGAGATCTGCAACAG
GCCTGGGA 37. chr1_CLSTN1_NM_001009566_-1.56235
GCAGGTGGGCTTAATGCTGATCTTCACCAAAACATCTTCTGTGGCTCTTT
TCTTCCCACAGTCATAGGCAGTGACGGTCAGCTTATATTGATGTTCTTTC
CCGTA 38. chr1_LZIC_NM_032368_-1.50995
TCTGCTAACCTTGTCCGAAGCTGACCTGGTTGTTTCTTTGCAAACAATCT
GATGACCTCTGGGGTTTTAAAGGCCTGGCTGATAGCTGCCTGAATAG 39. chr1_UBE4B_NM_001105562_1.82295
ATGATCGAAGAGAAAAGCGGAGCCTCAGTGATAA 40. chr1_UBE4B_NM_001105562_-1.73628
CTTCTTTGCGGTTGTGGTTGCCGAAATCCTTAAGTCCTGGCTGTGGGCGG
GAGCTGCAGAGACTCTCTTACTTAGGGGCTTTC 41. chr1_C1orf187_NM_198545_-1.69394
CGGAACCTCCCTGAGAATCACATTGACCTCCCAGGCCCAGCGCTGTGGAC
GCCTCAGGCCAGCCACCACCGCCGGCGGGGCCCGGGCAAGAAGGAGTGGG
GCCCAGGCCTGCCCAGCCAGGCCCAGGATGGGGCTGTGGTCACCGCCACC
AGGCAGGCCTCCAGGCTGCCAGAGGCTGAGGGGCTGCTGCCTGAGCAGAG
TCCTGCAGGCCTGCTGCAGGACAAGGACCTGCTCCTGGGACTGGCATTGC
CCTACCCCGAGAAGGAGAACCGACCTCCAG 42. chr1_C1orf187_NM_198545_3.40239
GAAACACCGCGGTAAACTCTCCAG 43. chr1_C1orf187_NM_198545_1.67365
TGCCAAATTCCACCGGAACCGCAGGGTTACACGGAGGAAAGGGCGCTGTG
TGGAGCCCG 44. chr1_TNFRSF8_NM_001243_-1.68857
GCCTACCTGGAGAGCCTGCCGCTGCAGGATGCCAGCCCGGCCGGGGGCCC
CTCGTCCCCCAGGGACCTTCCTGAGCCCCGGGTGTCCACGGAGCACACCA
AT 45. chr1_VPS13D_NM_015378_-1.51903
GAGTAAACGATGGACCGTGCGGCTGGATATTTCTGC 46. chr1_PRDM2_NM_012231_-1.60425
CCCTGGCTGAGGTACCCGAACATGTGCTGCGAGGACTTCCGGAGGAAGTG
AGGCTTTTCCCTTCTGCTGTTGACAAGACCCGGATTG 47. chr1_PRDM2_NM_015866_1.6502
CGGCAGGCTTAGAGTCAGGCATCTGCTGCTTCGGTGGGGGCCCAACGCGC
ATGCTGGGCGCCCGGGTGATTGAGATCCAAAGAGAAGGGCACTGTAAGAC
AGGCCAGATGAACTGGCTCCTCGTCATGGGACTGGTACCTCAGATCTGAG
CATGGCCCTTGTTTTTGGCACGTAGCAGA 48. chr1_DNAJC16_NM_015291_1.74663
ACTTTTTAACATGCCCCTGTGAACAG

Figure 3-5

49. chr1_AGMAT_NM_024758_1.62486
GTCTGCACCGGCAGGCGCATCATGGAGCAGACGCCCACCGG 50. chr1_SPEN_NM_015001_-1.58454
GAATCTGGGGTGGTGGCAGTCTCCCCTGAGAAAAGT 51. chr1_SPEN_NM_015001_-1.67843
TCCCAGCACCCTCCCGAGGAGGAAGTGCATTATCACCTTCCTGTCGCTCG
AGCCACAGCCCCTGTGCAGTCAGAGGTACTAGTCATGCAGTCTGAGTACC
GACTGCACCCCTATACTGTGCCACGGGA 52. chr1_EPHA2_NM_004431_-1.58277
TAGCCGGCCGCCATGAAGTGCTCCGTATACTGCTGCATCTTGATGGACTC
CAGCCACTCGGACACCGTGCGGAAGGGCAC 53. chr1_ARHGEF19_NM_153213_-1.50471
CCCGCAGGCTCAGCGTGGCCAGGACGCCGCTGCCGCGTACGTCGGGGATA
TC 54. chr1_ATP13A2_NM_022089_1.5575
GGCCAGGGCCACGACACGGTAGCCAGCAGCTGTATAGCTCTGCAGCATCT
GGGCGAAGTCGGTGGGC 55. chr1_ATP13A2_NM_022089_1.70127
TGACCTGGTAGAAGGCTTGCTGGGTCTCGATCCAGATATAGCGCTGGCCC
TGGAAGAGGTAATACCGCAGCACCCG 56. chr1_SDHB_NM_003000_1.94039
CAGGCTCCGCCAAGGGTTGTGGCCGGCAACCGGCGCCTCAAGGAGAGGGC
GACCACCGC 57. chr1_PADI2_NM_007365_-1.62119
CTTGCTGTAGACCTTCTCATCACGGCAGTCCTCCTTGGGCAACCAGGGTG
TCTCTCGGTCACAGTTCACC 58. chr1_PADI1_NM_013358_1.72693
TGCGGAACTTCCTGAAGGCACAGC 59. chr1_PADI3_NM_016233_-1.80052
ATTTCTCGGCATCCCCTATCTTCACTGACACTGTGGTGTTCCGAGTGGCA
CCCTGGATCATGACGCCCAGCACTCTGCCACCCCTAGAGGTGTATGTGTG
CCG 60. chr1_PADI3_NM_016233_-2.07034
ACGTGTTTTGTGGATGCGGTGGCAGAGCTGGCCAGGAAGGCCGGCTGCAA
GCTGACCATCTGCCCACAGGCCGAGAACCGCAACGACCGCTGGATCCAG 61. chr1_MRTO4_NM_016183_1.74895
GGGTCGGAGCCCATCTGATGAATACA 62. chr1_AKR7A3_NM_012067_-1.61534
TGTACATCTCTGCCCAGGTATTCCCA 63. chr1_PQLC2_NM_001040125_-1.58841
GATTGGCGGAGACTCCTGCAACCTCATCGGCTCCTTCCTTGCTG

Figure 3-6

64. chr1_PLA2G2E_NM_014589_-1.70181
AGGAACACCAGCACGTGGGGAGATTTCAT 65. chr1_VWA5B1_NM_001039500_1.56451
GCCTTCTGTGAGGCCACGCACATCCCCATGGAGAAGCTCAAGTGGACGTC
CCCCTTCACCTGCCATCGAGTGTCCCTCACCACCCGCCCGTCTGAGTCCA
AGA 66. chr1_KIF17_NM_020816_1.57193
GCAGCTTAATGTGGAGTGGCCTTCCTTGGGCCACAGACCAGCCAGGGGTG
GGCAGTGCAGGAAGACCTGCTGTGGGACCCCTGTGCCACCCCATGGGGCA
GGGCAGTGCTTAGGAAGTGGGGCCAGTCAGACAGAGGCACAGTTCCTTCC
CAGCTGATATTGAGCTTC 67. chr1_EIF4G3_NM_003760_-1.9397
AACGGGTTTGAGGTTGTGAATTCAT 68. chr1_HSPG2_NM_005529_1.77804
GCAGTGGGAGATGCCGTGCGCCGTGAGGTTGAGGTCATGGAAGACGATCT
CCTCGCCCTGGATGCGCAGCTCCCGGACACA 69. chr1_HSPG2_NM_005529_-1.63266
CTTGCACACTGGGGTTACCCACGTAAC 70. chr1_HSPG2_NM_005529_-1.64188
CAGACCGATGTAGCCTGGCGGGCAGCGGCACTCCTCCACCTCGAGGGCGC
GGGGTCTGTTTGAGGGCCCCGGCTGGGCGACCTCCAGGCTGACTGCGCTG
ATGCTGGCCGCCAGCGGCACGGAGGAGAACGTGGCCCGGATCAGGAGCTC
ATCCAGGTCGGCCAGTGCCATCAGGAGGTGCTCGCGTGTGGCC 71. chr1_HSPG2_NM_005529_1.90474
GGCTGCTGGGCGTAGGATGCTCGGATCAGGAGGGTGTCGATGCCTGCCAG
TGCCATCAGCAGGTGCTCCCGTGTGGCTGGCTGCCCATCGGGCCGCTGCC
A 72. chr1_HSPG2_NM_005529_1.8463
ATGCTGCCACGCTCGTCACAGCGCACAATCTC 73. chr1_HSPG2_NM_005529_-1.61123
CGCTCCGGTCAGGACAGTCGCTCTCCTCGTCACAGTGGAAGCTGGCTGGG
ATGCACATGTTGGTAGAGACGCATCGGAACTGTGTGGGCCC 74. chr1_HSPG2_NM_005529_1.70291
GATGAACACCACACTGACAACCTGGTCTCCGGGAAT 75. chr1_CELA3B_NM_007352_-1.80825
CCCGCAGGAAGCCCACGGTGTTCACTC 76. chr1_WNT4_NM_030761_1.67577
GACCCCATGCACTGTCCTGTCACAGCCGCACTTCTCCAGCTCCCCACTGC
TGCACGCCCCGCGTCACTGCAAAGGCCACACCTGCCGAAGAGATGGCGTAC
ACGAAGGCCGCCT 77. chr1_C1QC_NM_001114101_-1.65389

Figure 3-7

TGATCAGATTCAACGCGGTCCTCACCAACCCGCAGGGAGATTATGACACG
AGCACTGGCAAGTTCACCTGCAAAGTCCCCGGCCTCTACTACTTTGTCTA
CCACGCGTCGCATACAGCCAACCTGTGCGTGCTGCTGTACCGCAGCGGCG
TCAAAGTGGTCACCTTCTGTGGCCACACGTCCAAAACCAATCAGG 78. chr1_EPHB2_NM_017449_-1.80749
GCCACCGCCCATGGACTGCCCGAGCGCCCTGCACCAACTCATGCTGGACT
GTTGGCAGAAGGACCGCAACCACCGGCCCAAGTTCGGCCAAATTGTCAAC
ACGCTAGACAAGATGATCCGC 79. chr1_ASAP3_NM_017707_1.54419
CTTCTCGATGAAGGGGAACAGGCTCTGGGC 80. chr1_ASAP3_NM_017707_-1.81456
GTCACCCTGGCCCGATCGCGCTCCTTCTCC 81. chr1_MYOM3_NM_152372_1.63321
ATGACAACCAACTCTGAGGCCTTGGAGGGGACGCTGCTGCCTACCCTGCT
GATGGCTCTCACCCGGAACCGATAGCTCTGACCTTCGACGAGGCCTTGGA
TTGGGCACCGACAA 82. chr1_MYOM3_NM_152372_-1.79598
GACAGCTCGGAGGAGGCCGTCAGAGCCAGGGCTGCTGCCAGGGCGTAGTC
CGCGGCGCTGAACTCATGCT 83. chr1_GRHL3_NM_021180_-1.5746
TCTGCTGTATGTGCGGAGGGAGACTGAGGAGGTGTTTGACGCGCTCATGT
TGAAGACCC 84. chr1_NIPAL3_NM_020448_-1.7961
TCACAGATGTACGACTCCTCTTTGATTGCCAGTGTGGGCTACATTCTGTC
CACAACCATTGCTA 85. chr1_RUNX3_NM_001031680_1.78589
TGCTGAAGTGGCTTGTGGTGCTGAGTGAGCCTCGGGGGCTGGGTGTGCTC
GGTGTCACCCGCATGCGCAGCCGTTCCAGGTCCCCAAAGCGGTCAGGGAA
CGGCTTGGTCTGGTCCTCCAG 86. chr1_MAN1C1_NM_020379_-1.64768
CCATCCCGGGCGGCGCTCCGGACGCCCTCCCCTCACCGCGC 87. chr1_C1orf135_NM_024037_1.58907
TTAAAGTGCTGTACAGTTACCACAAAAATAAAATAGGAAACTAGCACCAT
TCTACCTCTCTTCTCTCCACACCTGGGTTGTGGGGAGATTTGCTAATCAC
TGAAAAAAAAGGGTCAAGAGTAATCATCCCAAGCTTAGGCTGATGTGGGT
TAAGATCAGCCAGAG 88. chr1_C1orf135_NM_024037_-1.53622
TCCAGGAAGGAGTGTTAGCATTTTGGTGCCTGGTTTGATTAAATGTGT 89. chr1_STMN1_NM_001145454_1.56006
AAGAGATCAGAGAATCTATGCGGAGAAGGTCTTCTTCTTCCAGTGTGGTT
GTAGTTGGCA 90. chr1_UBXN11_NM_145345_-1.86119

Figure 3-8

CCAGGACTGAATTTCAGGCTGGAC 91. chr1_PIGV_NM_017837_1.58258
AGGGAGCTCAATCCTGGTAGCAACACCCCTG 92. chr1_TMEM222_NM_032125_2.13592
TGGTTTTTCCCCATCATCGGCCAC 93. chr1_C1orf38_NM_004848_-1.52653
GTCAGCAGGTCATCCTGCACCTGCCCCTATCCCAGAAGGGGCCCTTCTGG
ACATGGGAGCCTAGTGCCCCTCGAACTCTGCTCCAGGTCCTACAGGATCC
AGCCCTGAAAGACCTCGTCCTCACCTGCCCCACCCTGCCCTGGCATTCCC
TGATCCTGCGGCCCCAGTATGAGATCCAAGCCATCATG 94. chr1_TMEM200B_NM_001171868_1.74809
GCGAGAGACGCGGCCCTCGGGGCTCC 95. chr1_MECR_NM_016011_-1.51333
CCTTGGCTGGATCCCCGTGGTGCCCATAGACAAGCGCCCGGACCCGGGCA
GGCTCGGCGGATGCGGAGTAGGAGGAGGCGGCAGGTCCGTGACAGCCAGA
AGC 96. chr1_PTPRU_NM_133178_-1.65407
CAACGCGGGCCAGAACGCGTCGTTCCAGTGCATGGCCGCGGGCAGAGCGG
CCGAGGCCGAACGCTTCCTCTTG 97. chr1_MATN1_NM_002379_-1.90946
TCTGGACTGGGGGGCGAGGCCAGGG 98. chr1_SDC3_NM_014654_-1.56844
GAGGCAGAAGCCTCCGTACGCCAGTGGTCCTTATAACAGCAGTGGTGGCC
GTAAAAGGGGGTGCTGCAGGGGTGCTGGGGGTGGCGGTGGCCACTGTGGC
AGGCACTGTGGCCACAGTCGGGTCCCCTGTGCTTGTGGCA 99. chr1_SDC3_NM_014654_-1.82338
TGTGCCCACAGGCTGGATGTTCGTGGTGGGCAGC 100. chr1_SDC3_NM_014654_-1.50388
CCCGAGTAGAGGTCATCCAGTTCATCATCGGGAAAGGAGTCATCATCCCC
AGAGCCCTCCAGGTCCACGGGTCTCTCGAAGTTCTCACTGCGCCAGCGCT 101. chr1_FABP3_NM_004102_1.61897
CCACCCCCAACTTAAAGCTGATCTCTGTGTTCTTGAAGGTGCTGTGTGTT
TTTAGGGTGAGAATGTCCCCATTCTTTTCGATGATTGTGGTAGGCTTGGT
CATGCTGGCCACCTGCCTGGTAGCAAAACCCAC 102. chr1_COL16A1_NM_001856_-1.60615
GGCAAGCCAGGGCTCCCCGAAGGCCCCGGAGCTCCAGGGTGGCCTCTCTC
TCCTGCAGGGCCCGGTGGCCCAACAGGCCCCATGGAACCACTCTTGCCAG
GTCC 103. chr1_COL16A1_NM_001856_1.59555
TGGGCGCAGTTGTCGAGGCCTGGCA 104. chr1_CCDC28B_NM_024296_-1.51723

Figure 3-9

CAGGCACACTACGGAGGGTCCCTGTGCCTACCAGCCACAGCGGCTCCTTG
GCCCTAGGACTTCCTCATCTGCCATCCCCCAAGCAGCGGGCCAAGTTCAA
GA 105. chr1_EIF3I_NM_003757_-1.58706
GGCGAAGATGGTTACGTCCGTATCCATTACTTCGACCCACAGTACTTCGA
ATTTG 106. chr1_MARCKSL1_NM_023009_-1.55206
TGGGGGGCGCTTGGAGCCGCCCCGGGCTCGCGCCGCAGGGGATAGTACGG
CGGGGTCG 107. chr1_KIAA1522_NM_020888_-1.65378
GGTCACGCCCTCGCTCCTGCAGATGGTGCGGCTGCGCTCCGTGGGTGCTC
CAGGAGGGGCTCCCACCCCAGCACTGGGGCCATCGGCCCCCCAGAAACCA
CTGCGAAGGGCCCTGTCAGGGCGGGCCAGC 108. chr1_YARS_NM_003680_-1.57318
GGCACAACCCTCCTAGAGGCGGGACGGTTTCCTGCCAATCACTGCTGGTT
TGCCCTCCCCCTGGTGTTGGCCCGGCTGACTCGGGGTAGGGGAGGTCGGG
GAGGGGGCGATAAAATGGCGCAGGGGGCGGAGTGAGGCGCAGTCGTTCGC
CCAGGCTTTGGCCCGGCTTCCGGAGGTGAAGAGCGGGAGGGACGAGGGGG
TCGGCGTTACCCGGCTTGGAGGGGGATGGGGGCGCCTGTTGCTTCTCCAG
GGGGTTGCGCACGCCGTCCGCCCCTTGGAGGGATTGGGAGGCCCACGCCC
TGCTGCGAGAAGGGCGCGTTCTAGCTCCTGAGGTGAT 109. chr1_S100PBP_NM_022753_-1.61614
TATCTCAGGAGTGTCATTGCTCAT 110. chr1_FNDC5_NM_001171941_1.50874
TCAGCTGGGACCTCGACCCGTTTGGG 111. chr1_CSMD2_NM_052896_1.52107
GTAAAAGTGATGTTGAAGCCCCTCTTCCCTGTGGAGTGGTCAGTCTGGAA
CTCGAGACGGGCCACGTGGCCACTGCTTGTGATGGAGGAGGGAAGCTGGT
TTCCTGAGAAGGTGCCCAGGACGGGCGCCTCGGCGGTGGCCCCATCCTTG
ATGACCAGGAAATCAAACTGAGGCTCCACGTCAATGTCGTTGAAGGCCAG
GTGGAT 112. chr1_C1orf94_NM_001134734_1.51371
AGTTCCTAAGCCTCACCAAAGAGCACTCGATCCTGGTCGAAGAGAGTTCT
GGGGAGCTGGAGGTACCCGGCAGCTCTCCCGAGGGGACCAGAGAGCTGGC
TCCCTGCATTCTTGCCCCTCCTCTAGTGGCAGGCAGTAATGAGCGCCCCA
GAGCCTCCATCATTGTCGGAGACAAGCTTCTGAAGC 113. chr1_LOC653160_BC021230_1.64843
AAGGCGGCCGCGAAGGCCACCGTGGCGGAGGCCAGCCCCGAGCTTGCCCA
GCGGTGCTCCAGGCAGGGAGGGGCCAGGCCCGCCAGCCAGGCGAAGGCGC
AGGCA 114. chr1_ZMYM6_NM_007167_-1.72728
TGGAGGAGGGCGGGCTTACAACCACTTGGCCCTGAGACAGGGGCACCGCC
GAAGAGTTTGTT 115. chr1_ZMYM4_NM_005095_1.52349

Figure 3-10

CTTCTGTAGTTGTATGAAAAAACAAATATTGTTAGCATAGTAGATAAATT
GTTATGAAATACCAGAAAAAAAAATCTGTATCTTTTACTGAGAACACCCA
ATACCCAGATAAATGACTGTATCAGGATTTCATTTGCATGTTAGTCCACA
GAGTTGCCCAGAACCCTAAATTTATTCATAAGAGAAAATATTGATTAATT
ATTGGTCATTCCTCATAAGTGTAGCTGTTGATGTGTGCGTCTGATTA 116. chr1_PSMB2_NM_002794_1.52264
GACTCCGAAGACAGTCAGCCAGGTTTCGGCGTGTGAAGTTAGCTGCTGCC
GTGGGAGACAATTCATATC 117. chr1_EIF2C3_NM_024852_1.63195
CATCTCAAGAACACATATTCTGGCCTACAGCTTATTATCGTCATCCTGCC
GGGGAAGACACCAGTGTAT 118. chr1_TEKT2_NM_014466_-1.62891
AGTGCCTGACCCTGCGGGAAAGCCGGCGAGACATTGATGTGGTGAAGGAC
CCTGTGGAGGATGAGCTGCATAAAGAGGTGGAGGTCATCGAGGCCACCAA
GAA 119. chr1_TEKT2_NM_014466_-1.62367
AGGATCTGCGCACAAAGCTCCTGAGCCTGAAGCTGTCCCATACCCGGCTA
GAGGCCAGAACCTACCGGCCCAACGTGGAACTCTGCCGGGACCA 120. chr1_COL8A2_NM_005202_1.93319
GGCAGTCCTGGCATCCCATAGCCAGTGGGGCCTATCAGCCCAGGGGGGCC
CCGGGTCCCTGGCTCCCCTTTGGCCCCTGATGGGCCCTGTGGTCCTGGCA
ACCCTGCTGCCCCTGGGACTCCCACACCGTCTACTCCAGGAGGTCCTTTT
GGGCCCACAGC 121. chr1_MAP7D1_NM_018067_-1.50888
GAAGGAGAAGAGTGCCCTAGCCCGGGAGCGCAGCCTCAAGAAGCGCCAGT
CGCTGCCCGCCTC 122. chr1_OSCP1_NM_145047_1.5327
GAACAGGCCCGGACACCGGCAACACAAAGCGACCGTTATTATTCTGAACT
TTG 123. chr1_OSCP1_NM_145047_1.7632
ATGAGGAGTGTCTGCCGGATCAGCTGGAACT 124. chr1_OSCP1_NM_145047_1.82644
CTCCCGGGATGTTCTGGGCCCGCAGCCGTTGGTCGAGGATGTAAAGCATC
TCCCCGCCCAAGTTCAAGAAGAGCAGCGGTAGCGTCCGCACCGACAT 125. chr1_RSPO1_NM_001038633_-1.58763
GCACTTGTTCATGTCGGGGTTGCGGGCGTCGAAGTATCCAGGTGGGCAGG
ACGGCAAGCAGACGCCCACCTGGCGGATGTCGTTCCTCTCCAGCAGGATG
AACAGCTTGGGTGAGCAC 126. chr1_C1orf109_BC018109_-1.56909
TTGTACAAGATCTTGGTGTTCGTCTTTTGAAATTCGGTCCCAGGCCTTGG
GCAAAGCTTGTATGTTTGCCAAG 127. chr1_CDCA8_ENST00000373055_-1.57627
ACGTGCCTGGCGACTTCTTCGGGTGGTCCCCGTCCGCCCTCCTCGTCCCT

Figure 3-11

ACCCAGTTTCTTGCTTC 128. chr1_POU3F1_NM_002699_2.02443
GGGTGGCGATGCGCCGCCCCCGCCA 129. chr1_MACF1_NM_012090_-1.50158
GTGCTAGAAGATAATTCTCAGCGGACCAAATGGAAAGTGATCAGCCCCAC
AGGGAACGAGGCAATGGTGCCGTCAGTCTGCTTCCTCATCCCCCCACCCA
ATAAGGATGCCATTGAGA 130. chr1_PABPC4_NM_001135653
GACTCTCTGAGTGGTAGTAGGGAGGCCACGAGAGGCCGGAGCATTAC 131. chr1_COL9A2_NM_001852_-1.81633
AGCCCTGGGGGACCTTTCATTCCGGGTGGACAGTTG 132. chr1_EDN2_NM_001956_1.51279
TGGAATGTGTGGACCGAGGCTCCCGCATGGCCTCCTGTTGTCGCTTGGCA
AAGAGGCTC 133. chr1_HIVEP3_NM_024503_-1.60027
CGGAGAGGTTCCTCGTCCGGGCTGGGAAGCGGGCAGAGGCCTCTGCCAGG
CAGCCCACAGAGCTGCTGCGGTCCAGCGGCGGGGTGGCAGAAGGCTCGGG
GTTGGTCGGTGCACGCGGGGACTCCAAGCGGGGGCTCCAGGACTGCGCTG
CCCGGCGTCCCTG 134. chr1_FOXJ3_NM_014947_-1.63938
GGCCGCTCCGTGCGTCTCCGCCCCCCCGGGAAAGGTCCCAACGGTGCCTA
CTGCGAGCGGTCGAGGCCCCGA 135. chr1_RIMKLA_NM_173642_-1.51239
TGGACCAGATCGCCGTCACCATCGTCGGCGGCCACCTC 136. chr1_LEPRE1_NM_022356_1.75998
CATCCTTGGGCTTCGATTCACTGC 137. chr1_ERMAP_NM_001017922_2.82256
GGAGAAGAGCCCGGTTGCATTTTG 138. chr1_EBNA1BP2_NM_001159936_1.75842
TCTCTGTCTGTGACAAGGGATTCATCGGATTCCGACTCCGAATCCGAGAG
CGGG 139. chr1_PTPRF_NM_002840_1.56328
CCCTTGGTGCTGAGTATCCAGCAAGAGTGACCGGGGTGAAGAAGCAAAGA
C 140. chr1_KDM4A_NM_014663_1.71205
GACATCTGAACAGCTGACCCCTGAGGAAGAGGCTGAGGAGACAGAGGCCT
GGGCCAAGCCTCTGAGCCAACTGTGGCAGAACCGACCTCCAAACTTTGAG
GCTGAGAAGGAATTCAATGAGACCATGGCCCAACAGGCCCCTCACTGCGC
TGTCTGTATGATCTTCCAGACTTATCATCA 141. chr1_ST3GAL3_NM_174963_-1.79626
AGTCACTGAGCGAGGACACAGCCTT

Figure 3-12

142. chr1_ST3GAL3_NM_174963_-1.58904
TTCTGGAAATCTGTGGCCACTCGAGTGCCCAAGGAGCC 143. chr1_DPH2_NM_001384_2.00366
TGCTGCGTGGATGTGCTGGGTGCTGAGCAAGCTGGAGCTCAGGCTCTCAT
ACATTTTGGCCCTGCCTGCTT 144. chr1_DPH2_NM_001384_1.51169
GAGGGTCTGTCCTTGTCAAAAGGCAGGTGCTAGACAGTCTAGACCAGGGT
TTCTCAAACTCGTACTTGACATTTGGGGCCAGATAATTCTTTGTTGTGGG
GCTGTCTGGTGTATGGTAGGGTGCTCAGCAGCATCCCTGGCCTCTGCCCA
CTAGACATCAGAAGCACTCCCCCAGTTGTGACAACCAAAAATATCTCCAG
ACCTTGGCAAATGTTATCTGTGGGGGAAAATTGCCCTCAATTGAGAACCA
CTGGTCTAGCTAGACCTGCACTGTCCAGTACAGTAGCCACTAAATACATG
TGGCTAAACTTAAATTTAAGTTAATTAAGATTAAAAGCTCAGTTTCTCAG
TCACATTAGTCATTCAAGTGTTCAGACAGCCACATGAGGGGACAGTGCAG
CTACAGGATATGCCATCATGGCAGAAAGTTCTATTGGTTGGACAGCGTTG
GTCTATACTGACTCTTATTTCTCAGGGAGATCACAGCAACCTAAATA 145. chr1_CCDC24_NM_152499_1.6653
CATCATCAAGGACCAACTGAACGTGTCCAACATTGACCAGGTGGCCAGAC
ACCTGA 146. chr1_SLC6A9_NM_006934_2.04373
GAGCCATTACTGCCCACAATGGGGATCTGCGCCTTGTCCGGGTGCAGTGG
CTGGACCTCGAAGCCGTCCTCAGGAGAGGGGGCTATGGTGGGGGCGTAGC
GCCCTGTCCGGTGCTCCAGG 147. chr1_RNF220_NM_018150_1.61889
TGGCTTCATCATGTGCAGCGGCAAAGAGAACCCGGACAGTGATGCTGACT
TGGAT 148. chr1_KIF2C_NM_006845_1.59041
CTGGGACAGAACAAGGCTCACACCCCGTTCCGTGAGAGCAAGCTGACACA
GGTGCTGAGGGACTCCTTCATTGGGGAGAACTCTAGGACTTGCATG 149. chr1_PTCH2_NM_003738_-1.52483
GACTGGAGCAGCAACGGGGCAAACTGATAGCGGGCGAAATGGGCAAGATT
CCAGCGGGCACAGGGCAGGGACTTGCAGGCTGCCTTCTGCCTTGTCTCCT
CCTCCTGGCCTAGAAGGTCCCGTGTGGA 150. chr1_HECTD3_NM_024602_-1.54226
ATCAGCTGTCCGATCCATTCATACTTGGCAAAGTCTCGGCAGGAGGGGTT
GGGTACATACATGTCCCGAGCCTCA 151. chr1_NASP_NM_172164_1.66088
CTCTATTCCGTTCGCTGGTTCGCCACCTCAGGGGAACG 152. chr1_GPBP1L1_NM_021639_1.52786
ATCAGAGGAATTATGTCGACGGCGGCTTACTCCAAATCTACCTTCTCCTC
TGGGTAGGTGCTCTCCGTGTTTTTCGAAGGTGGCAGTAG 153. chr1_POMGNT1_NM_017739_1.88933
GCTCGGGCCCCGCTAGGGCCCTCAC

Figure 3-13

154. chr1_FOXE3_NM_012186_-1.50319
AGCGCTTCAAGCGCGCCGAGCTGCCCGCGCACGCGGCCGCGGCGCCAGGG
CCGCCGCTCCCCTTCCCCTACGCGCCCTACGCGCCCGCGCCCGGCCCCGC
GCTGCTGGTGCCGCCGCCTTCTGCCGGACCGGGCCCCTCGCCGCCCGCGC
GTCTGTTCAGCGTCGACAG 155. chr1_FOXD2_NM_004474_-1.85894
CGGCTACGGCTACGGGCTGGCTCTCCCGGCCTACGGCGCACCCCCGCCGG
GGCCGGCCCCGCATCCGCACCCGCACCCGCACGCCTTCGCTTTCGCCGCG
GCAGCCGCCGCCGCTCCTTGCCAGCTGTCGGTACCCCCAGGCCGCGCCGC
CGCGCCTCCACCCGGACCTCCGACGGCCTCGGTGTTCGCAGG 156. chr1_RAB3B_NM_002867_1.54496
AGCTGGCCCTTCTCAGTGGGAACAACCCTCTCTTCCTC 157. chr1_ZCCHC11_NM_001009881_-1.55899
TGCGAGGCCCGCGAGCTACAGGCGCGCG 158. chr1_GPX7_NM_015696_2.09954
CTTTGCCCTCGCGACGCCGCCACCTCC 159. chr1_ZYG11A_NM_001004339_1.87509
GGTTCATTTCTTGCACCCGGGCCACACGCCCCGGAACATCGTCCCTCCTG
ACGCT 160. chr1_SLC1A7_NM_006671_1.73482
TTCCACGCATGAGAGCCCGGCCGGGGGCACAGGGTCTGGGCTGAGGGCTC
TAGCCCCTCAGCAGGCAGGTGGTCGGAGTTGCTAAACACCAGTCGCCAGC 161. chr1_FLJ40434_NR_002314_2.02739
GCTCGCAGGGTGCTGGCGTAGCCCGGTCGCGTCTGCACGCGGA 162. chr1_ACOT11_NM_015547_-1.68716
CTTGGCCACCTTCGTGGCCCGCCGAGAGATCACCAAG 163. chr1_C1orf175_NR_026782_1.53806
CCCAGAAATCATGCAAGGCATCTACATGCAGCTGAGCCACATCCAGGAGC
CTCGGGCCCGCCAGGTGGCCCTGCTGCCCGTCTCCCTCCTGGCTAGCTCC
TTCATGACCGAGGTTGTGGTGG 164. chr1_TTC4_NM_004623_1.54521
TCAGAATGAGGCTTTACTCCAGGCCATCA 165. chr1_PPAP2B_NM_003713_1.62573
CCGAGGCTGCTGCGGATAGTGGCGGGTCGGCCCCGGCTC 166. chr1_ALG6_NM_013339_1.6427
CAGTGGTTTTGTACTGTTGTTGCT 167. chr1_EFCAB7_NM_032437_-1.67128
TAGAGCTGCCTACTTAACTGTCTT 168. chr1_ROR1_NM_005012_-1.78883
TGCGCTGTTCTCGGAGTCCGACCCAGGGCGACTCACGCCCACTGGTGCGA

Figure 3-14

CCCGGACAGCCTGGGACTGACCCGCCGGCCCAGGCGAGGCTGCAGCCAGA
GGGCTGGGAAGGGATCGCGCTCGCGGCATCCAG 169. chr1_ROR1_NM_005012_2.02729
CCGGGAAGAGCCCGTGGATGTTCTG 170. chr1_CACHD1_NM_020925_1.69169
GTCCACCAGGAGCCGGTGACATACACAGCTATTGACCCTGGCCTGC 171. chr1_DNAJC6_NM_014787_-1.59491
TCTTGTGGCAAGCTATACCGGAAAAGCGGCATGTCAAAAATACTTTAGGT
TCTACATAGATCTCTTTCTCTCTTTTGTTTTGTTTGTTTGTTTGTTAAAG
TTCATTATTTATTTTACCTTTTACTGACAATGTGAAACTCGAAGAAAATG
TTCTCTTTTTAAATATACAGTCATAAACTGTTCAAGGTAACCATAACAAA
CTAGGTGTTATTTATTAACGTATTATAAAATAATGTTTGATCCAGTATGT
GCTTGTCTTATTTAAAATTGGAATGTGAGACATGTTGCTGTGACCTGT 172. chr1_INSL5_NM_005478_1.53679
GCACTCAAATCAGTCATGGAACAGCCATCAGTGCAACACAAAGTTTGTAA
ATCTTGTCTTGACATCACTGAATGCTTCTTTGACTTCCAAAGCTCTTCAG
TGGGCATCTGTCCACCCCAAAGACGGTCTTCCCCTGAGGCATCCACCTTC
GGAAGGTTTTGCGCTGGATTTTCCTCAGAAAACTCACGTTTATGTGGGAG
CTGGAAGGAGTTTCCTGTCTCA 173. chr1_MIER1_NM_020948_-1.81195
CATCTGTTGAATCTTCAAGTCCAG 174. chr1_CTH_NM_001902_1.7187
TGCAGGAAAAAAGACGCCTCCTCACAAGGTTTCCTGCCACACTTCCAACAT
TTCGCCACGCAG 175. chr1_ZRANB2_NM_203350_1.59156
GATCCAGATGATGACCTGTGGCGT 176. chr1_LHX8_NM_001001933_-1.9064
GCGAACCGGCTGGAAAGAAACACCGAGTCACTCGTACAGACTCTTGGTCG
CAGAACTTGGCTTTCCGCTATTGGTCCTCCAGAACCGCTTGAAACAACTG
GCCCCAGCTGGCGCATCAGACCGCAGTGAGGAATGCCGCGGGGCGGGTGG
CGAAGGCAGGGTCTGCCCGCCAGTGGATTCCCGGGTGTCCCGCGTGGAGC
AGGCTTGCCCAGCTGGGAAGCCCATCAAACCTCAGTCTTGGCCCACAGTG 177. chr1_LHX8_NM_001001933_-1.57821
GCAAGGTATAAAACGGAGTCTGGGA 178. chr1_ST6GALNAC3_NM_152996_-2.11125
AGGCGCGCCCGCTGCTCGGTGGCAGGAG 179. chr1_ELTD1_NM_022159_1.69847
GGACCAGAGGACATCAAAATTGCAAAATGTGTCAGGTGATTACAGCGGCA
TGAGGTGTGGGTCTCATTTGAGTATGTCAGCTCACAGCCCTCTGAAGACC
AGCTGCCATTCATGGTATCAGG 180. chr1_COL24A1_NM_152890_1.8348
TTAGTCCTTGTTCACCCTGGTCACCT

Figure 3-15

181. chr1_CLCA2_NM_006536_-1.74649
AGACCCATGGCCTTCGACTACAAAAACATACTAACAAAGTCAAATTAACA
TCAAAACTGTATTAAAATGCATTGAGTTTTTGTACAATACAGATAAG 182. chr1_BARHL2_NM_020063_1.79784
CCTGCCCACTGGTAAGCATCTTCCTCTCTTACTCCTCTGCCTTCCAGAGT
TGGCTGCAAGGGAGGCCTAGTGGCCTGGAGCAGGGAGAGGACGGGCAGCA
GTCCGGGTT 183. chr1_BRDT_NM_001726_1.60205
TGGGAGGTCAAGTTAAGAGTCAAAA 184. chr1_DR1_NM_001938_1.84261
GCCTCGGGCTCTATAGAGCCGAGCCCGCTGGGTACCCGCCCGGTACCGCG
GCGAGGCCAGTGCCCCTGGATCTTGCCTCTGCTCCGACGCCGTTGGGGAC
CAGT 185. chr1_SLC44A3_NM_152369_-1.551
GGCGCAAACTTGGGGTCGTCCTCAGGT 186. chr1_CNN3_NM_001839_-1.95194
GAGGACTCGTTGACCTTCTTCACT 187. chr1_LPPR4_NM_014839_2.12424
GATCAAGGACAGCGTCACCCTCCTGCC 188. chr1_PALMD_NM_017734_-1.54334
AGTAAGTTCTAATCACAGTGCAGCATACAATGGCACCGATGGCCTGGCAC
CAGTTGAAGTAGAGGAACTTCTAAGACAAGCCTCAGAGAGAAACTCTAAA
TCCCCAACAGAGTATCATGAGCCTGTATATGCCAATCCC 189. chr1_HEJ1_NR_033424_-1.70023
TCATCAGATAGAACCCGGAATAGCTCAGCAAATTCAAGC 190. chr1_WDR47_NM_001142550_1.94302
CTTTCGACCTTGAAAGACTCCCTGG 191. chr1_ATXN7L2_NM_153340_-1.64813
AAGATCCCACCGGCAGCTGAACCTCCAGCTCACCTTGTCAACTCCCCGTT
ATCTGCTCCCCTGAGCCCATCCTCTACAGGCACCTGCCCCCGCCTTCCAG
GTCCAACCCTGAGA 192. chr1_CYB561D1_NM_182580_-1.54243
TTTCTCCTGGCACCCTGTATTCATGG 193. chr1_EPS8L3_NM_139053_1.55565
AAGGAGAGGGACTGAACAGATTCTTGACAAGCCTAGGCATAAATGCTCCA
GGTTTGGGAAAGAGGTAAAATAAATAGGTGGTTACTGGGGAGGCTCCAAC
ACAGCCAGAAGGGACACTGTTTGCTT 194. chr1_FAM40A_ENST00000369794_-1.60721
CTGTGTTCGCCCTGCAGTTTCCGCCTTGGCAGGAGGCCAGGCACAAGACT
GACATATGGGCTCAACCAGTGCCTGGCCTTGCCTGTGTCACCTTTGTCCA
GTG

Figure 3-16

195. chr1_FAM40A_NM_033088_1.58108
TTCTGTCCTGGATTACCCTCACTGCGTGGTGCATGAGCTGCCAGAGCTGA
CGGC 196. chr1_RBM15_NM_022768_-1.66492
GACATCGGGCACCAGACCCTTTGAGGGGTGCTCGGGATAGGACACCACCC
TTACTATACAGAGATCGTGATAGGGACCTTTATCCTGACTCTGATTGGGT
GCCACCCCCACCCCCAGTCCGAGAACGCAGCACTCGGACTGCAGCTACTT
CTGTGCCTGCTTACGAGCCACTGGATAGCCTAGATCGCAGGCGGGATGGT
TGGTCCTTGGACCGGGACAGAGGTGATCGAGATCTGCCCAGCAGCAGAGA
CCAGCCTAGGAAGCGAAGGCTGCCTGAGGAGAGTGGAGGACGTCATCTGG
ATAGGTCTCCTGAGAGTGACCGCCCACGAAAACGTCACTGCGCTCCTTCT
CCTGACCGCAGTCCAGAATTGAGCAGTAGCCGGGATCGTTACAACAGC 197. chr1_CHI3L2_NM_004000_1.52955
CATCAACCTCCTGTCCTTTGACTTCCATGGGTCTTGGGAAAAGCCCCTTA
TCACTGGCCACAACAGCCCTCTGAGCAAGGGGTGGCAGGACAGAGGGCCA
AGCTCC 198. chr1_CHIA_NM_021797_1.84664
TCTGTGCACGAACAGGTGGCCGACTCTGG 199. chr1_CHIA_NM_021797_-1.66316
CATTGGAGGCTGGAACTTCGGGACTGCCCC 200. chr1_KCND3_NM_004980_1.53114
GCCGGCTCGCCGAGCTGGAGAACTTTGCGAAG 201. chr1_ST7L_NM_017744_-1.57194
TTGCCGCTATCGCAGGCGCCAGGAG 202. chr1_MOV10_NM_020963_1.54724
CTGTACGACCGGAGTCTGGAGTCAAACCCAGAGCAGCTGCAGGCCATGAG
GCACATTGTTACGGGCACCACCC 203. chr1_RHOC_NM_175744_1.6431
AGAGAGGCCGCAGTCGATCATAGTCTTCCTG 204. chr1_ATP1A1_NM_000701_-1.54618
CCAGAAAGGATCCTAGACCGTTGCAGCTCTATCCTCCTCCACGGCAAGGA
GCAGCCCCTGGATGAGGAGCTGAAAGACGCCTTTCAGAACGCCTATTTGG
AGCTG 205. chr1_TTF2_NM_003594_-1.52546
GCTTTCTTAAGACCGGCGTCCGCGATGGCCCGAATAAAGGAAAGAGCTTC
TACGTGTGCCGGGCAGACACGTGCAGCTTCGTGCG 206. chr1_PHGDH_NM_006623_1.52432
CAGATTCCCCAGGCGACGGCTTCGATGAAGGACGGCAAATGGGA 207. chr1_PHGDH_NM_006623_-1.91442
CTTTGCCCAGTGCAAGAAGGGGGTGCGTGTGGTGAACTGTGCCCGTGGAG
GGATCGTGGACGAAGGCGCCCTGCTCC 208. chr1_HMGCS2_NM_005518_-1.78362

Figure 3-17

GACGCCGGGCATACTTTCGGCGATGCTGCTCGTCCACTCGCTCCAGGTAC
CAAGTACCTGGGAAAAGGCTGTTTGTGTCAC 209. chr1_NOTCH2_NM_024408_1.56525
ACTGTGACTGGGTGTTCGCTCAGCAGCATTTGAGGAAGCATAACTGTGCT
GTGAAGGGGGTGTGGGGTACTTGCCCACAGAGGCTGGGAAAGGATGATAG
GCTGGGAGAATGGTCTGAGCTACCTGCCCGTCCTGCTGGGGCATCATGGC
AGTGGGGAAAGCCACACTGGGCAAACGGGCCATTTCTGGAATCTGGTACA
TGGTGGGCAGGGGGCCCGCAACAGCTGGAGGGCAGGTGGACTGAGGCTGG
GGAGCCCCCGCTGGTTGGGCAATACTGCCTTTAGGGATGAGCTGGAAAGT
CACAATGGGGGGCAAGGGCTCCCGAGGGGTGGTTATGTGCTTCCCTTCAG
GTGGCCTGCTCTGGGGAGCTATGCCAGGATGGGTGCCCTCAGCTGGAGCC
AGGACCATACCAAACATCTCATTGTACTGGGTCTCATTCACCTCCATGCG
GTTCATCCAATCTGCTGGGACTGGGACTGGATGGAGCCTACTCAAGCTTC
CAGCACTGCCACTGCCTGGAGACACAATGTGGTGGTGGGATAGCAACTGG
CTCACTGAGGGAAGCACAGTGCTGGCCCCATGTGCCAAAGGCTGCATTTC
ATGAAGGTTAGAAAAAGATAGTGCATGCTGGGCATGGACTGGGGCAGGAG
GGGCGGCAGTGGCCAACATAGGGTTGGGTGAGGCCTGTAAGATCCCAGGG
GATGTAATCATTGGAGAGGATGTGGTGTCGGAAACATACGTGTGAGGAGA
TTCTAGGGAATCAACAGGGGATAAAGTTACTGAACTCTCAGACAGTTGGA
CCTTCTCACTCAGAGACTTCTTCCTCCTACTACCCTTGGCATCCTTTGCC
TCCTTGGCAAGGTTAGGGAGGCTAGTAGGCATGGTACTCTTGGCACTGGG 210. chr1_HFE2_NM_213653_-1.78466
TGCAAGATCCTCCGCTGCAATGCT 211. chr1_PEX11B_NM_003846_-2.06987
TGGACGCCTGGGTCCGCTTCAGTGCTCAGAGCC 212. chr1_ACP6_NM_016361_-1.50106
CAGCCAGCAAACAACGGGTGGACTCCAGATTCCGAAAAATGTTAGTGGA 213. chr1_BOLA1_NM_016074_1.52848
CCATGGCTGGCCGCGTTTGTTTGTGCCAG 214. chr1_MTMR11_NM_001145862_-1.74453
CAGAGGAGATAGCAGGTCGAGGGAGCCAACGAGAAGAGACTGCCAGCAGG
GAAGGACTGTCCCGCCAAGGACAGAGCTG 215. chr1_OTUD7B_NM_020205_1.76146
TGATCCTCAAGTACTTTCAGCCAG 216. chr1_C1orf54_NM_024579_1.67645
ATCAGGTGGTCTATTATTATACAG 217. chr1_ECM1_NM_004425_-1.62208
GACCGGGAGTATGCTGTGAAGACCCACCACCACTTGTGTTGCCGCCACCC
TCCCAGCCCTACTCGGGATGAGTGCTTTGCCCGTCGGGCTCCTTACCCCA
ACTATGACCGGGACATCTTGACCATTGACA 218. chr1_ARNT_NM_001668_-1.63693
TGAAATTCTCTGCCGGCCGGGGGGTAGGAGGGAATGTGTTGCCCTGGGAG
AATAGCTGTTGGGTGGCAGGGA 219. chr1_SETDB1_NM_001145415_-1.54115

Figure 3-18

CCAAACATGTGCACAAACCGGTTGGTGCAACATGGACTACAAGTTCGGCT
ACAGCTATTCAAGACACAGAACAAGGGCTGGGGTATCCGCTGCTTGGATG
ACATT 220. chr1_ANXA9_NM_003568_1.58627
TGGCACCGTCCCTCACCCAGGAGATCCTC 221. chr1_FAM63A_NM_018379_-1.55674
AGAGGATGTTCATGATGGCAAGGAGAGGGCAAGGGCCGTTAGTGCTCTGG
GTGATGATGGGTGTCTGTTCTCCTTTCCAAGGGATCCACT 222. chr1_PRUNE_NM_021222_-1.52633
AGTCCCGACCTCTACATGTTGTGCTGGGAAATGAAGCCTGTGATTTGGAC
TCCACAGTGTCTGCTCTTGCCC 223. chr1_PI4KB_NM_002651_-1.96109
ACAGCCAGACTTCGAGCTTCCAAG 224. chr1_RFX5_NM_000449_1.52635
ACCAAGGGAATTTTATCTTCTGCTTCTTTGGTATGCTGGGAACCGGGGCC
CCTTCCTCCTTTGGAAACAGTACCATCTCCCTGACCCTGGGCAAGTACTG
CCCCCTTTTCAGCCTCTCCCATTGGCCCTGGCCTCTCTGCCCCTCCAGCT
GAGTTGCCTTCC 225. chr1_RFX5_NM_000449_-1.6457
GCCACCAAGCCTTCGAGCTTTGATGTCAGGGAAGATCTCTCTGATGATCT
TGCCAAAGTTGGCTGTGCTGAGTGGGCGGCAACAGGCAAGACTCTCACAG
TACTTC 226. chr1_CGN_NM_020770_-1.50568
GGACCTGAAGACCCGGTTGGCCAGCTCAGAAGGCTTCCAGAAGCCTAGTG
CCAGCCTCTCTCAGCTTGAGTCCCAGAATCAGTTGTTGCAGGAGCGGCTA
CAG 227. chr1_CGN_NM_020770_1.70429
TTTGAAGCGTCAGGTGGATGAAGCAGAAGAGGAAATTGAGCGACTGGACG
GCCTGAGGAAGAAGGCCCAGCGTGAGGTGGAGGAGCAGCATGAGGTCAAT
GAACAGCTCCAGGCCCGGATCAAGTCTCTG 228. chr1_TDRKH_NM_001083965_1.75644
GCTGCTCCAGTCAGCCGTCGAGTGCGCCGCCTCG 229. chr1_CRNN_NM_016190_1.83382
CACACAGCGCCTTGGGTGAGTGCTGCTCCACTCCTGCCTTCCTGACTCAG
TGCTTGCCCCAGTCTGGGCCTGTCCTCCCGGTACTGTCTCTCCTGCCTCA
GGGTTGCTCACTTGCATCCATCTTTGACCACTGCCTGGCTGCGTCTGGGT
CTGTCCCTGTTCTCTAGCCCCTCCGTGGCTTACAGTTTGGCTTCTGTCCT
GCTCCACAGTCTCGGTGTGTGACCCTGCCTGTATCTGAGTGTGTCCTCCT
GTCACAGCCTGGCTGGTCTGGCTCCTGCCTTGACCGTGGATCTCAGTCCC
TCTGTTCTGGCCATTGGTGGACTCCTGTGTCTGGGTGCTGGTGCTTCCTG
TCTGGTGGCTGCTGTCCTGCTCCACGGTCTGGGTGGGTGTCTGGGTGTGT
GTCCCTGCCTGTATCTGAGCATG 230. chr1_CRNN_NM_016190_1.56819
CCCAGGTGGGATGAAACAAGTGGCTGTTAAGTGGTGTGAGGAGT

Figure 3-19

231. chr1_SMCP_NM_030663_-1.63367
TTGGAGACCAAGCCTGAAGTCTCACCCCTTAACATGGAGTCTGAGCCCAA
CTCACCGCAAACTCAGGACAAGGGCTGTCAAACCCAGCAGCAGCCCCATA
GCCCACAAAATGAGTCCAGGCCAAGCAAATGA 232. chr1_PGLYRP4_NM_020393_-1.87753
AAAGCCTGCCCAGGAGACAAGGTTCGGGCCACATCA 233. chr1_S100A8_NM_002964_1.55968
TTTGAACCAGACGTCTGCACCCTTTTT 234. chr1_S100A7_NM_002963_-1.50144
TGCCCCCGGAACAGGGCGCTGCTCCATGGCTCTGCTTGTGGTAGTCTGTG
GCTATGTCTCCCAGCAAGGACAGAAACTCAGAAAAATCAATCTTCTTATC
CTCATTCTTGTCCTTTTTCTCAAAGACATCGGCGAGGTAATTTGTGCCCT
T 235. chr1_---_---_1.65589
AAACATGGCCGTACAGTAACCTGCTATACATTCTTTCAGACACACACACT
CCAGCGTTTGTCCCTTATCACTCATTAA 236. chr1_DENND4B_NM_014856_1.52485
TGCACTAGGATGCGGGGTCTCTGTGGGGAAGGGAAGGGAACGTTGTGAAT
GAAGTGGGAGATGTGC 237. chr1_CRTC2_NM_181715_-1.7232
GAGCTGTATGGGTATGGGGGTAACCGCTGGTCAGTGGACAGTTTACTGGT
ATCCAGGG 238. chr1_CREB3L4_NM_130898_-1.53815
CTCAGGAAGATTTACTATAGCTAAGAGAAAACTGCAGCAGAAAGGGCGCG
GCTACCTACTTCTTAAATTCCGTTTGTGGACCCTCAGACTCTTAGTCCCC
TACTCCCAGATACAGCGGCCCTA 239. chr1_IL6R_NM_000565_-1.8999
CACTGTGTCATCCACGACGCCTGGAGCGGCCTGAGGCACGTGGTGCAGC 240. chr1_IL6R_NM_000565_-1.6486
CTGGGGTCTGACAATACCTCGAGCCACAACCGACCAGATGCCAGGGACCC
ACGGAGCCCTTATGACATCAGCAATACAGACTACTTCTTCCCCAG 241. chr1_TDRD10_NM_001098475_-1.95808
CAGCGACGACTTCTGGACCATCCCACCCCTG 242. chr1_ADAR_NM_001111_1.61072
ACAGGTTTGACTAGCGAACTGGGCATATTCTAACAGCCCGCTGATGGGGT
TCTTCAGCTGGCACTCTGTCAGTTTCTTGTAGGGTGAACACCGTGGCAAG
CCATGACTGTAGAAGGAGGGCATCTCCATGATGGCTCGAAACTCACCTGG
TGCTGCGCGGATACTATTCAAG 243. chr1_ADAR_NM_001111_1.5391
TGTCTATAGACATCCCCCTGCCTTTCCATGTCAATTAGCACAGCATTTAT
ATCTCGGGCCTTGGTAAGGCCAATATTTTTAGCCAAATTCAGGGCAGAGG
AGTCAGACACATTGAAGAGATAGTCGCAGATTTTCTCCTTG

Figure 3-20

244. chr1_PYGO2_NM_138300_-1.5545
CCTCACGGATGTAGACAGACTGGATCTCCTTGGTCTTGAGGCAGAGATCG
CAGGCCCAGACGGCAGAAGCTTCAGTGGTCAGCAGCCCATAGGCGCTCTC
AGTCATGCCTGTGCACTCACGGTGGAACCATTTCTG 245. chr1_SHC1_NM_183001_-2.06403
CTTAGCCTGGTTGGACCTCTGTGGCCCAGGAGTCACAGAAGTCCTGGGGA
GGGAGAGGGACAAGTGGCTTCCGCTCCCCAGCTCAGACCCAGACAGTTTC
AGGCCCCATCCC 246. chr1_DCST2_NM_144622_-1.74
AGTGGGGGCTCCTTTAGTGGCGGAGGATGTCTCAGGTGGTCTGTGGGGCT
CAGGGC 247. chr1_ADAM15_NM_207191_1.76776
CCTCCGCGCGCTGTTCCGCACTTGCTGCC 248. chr1_ADAM15_NM_207191_-1.51958
ACCGCCTCCGACAGTGTCCTCGCTCTACCTCTGA 249. chr1_TRIM46_NM_025058_-1.734
GCGGTACCGCCAGAGTGTGAGTGTGGGAGGTGCCATCCTGTGCCAGTTGT
GCAAGCCCCCACCACTAGAGGCCACCAAGGGCTGCACAGAGTGCCGCGCC
ACCTTCTGCAATGAGTGCTTCAAGCTCTTCCACCCCTGGGGCACCCAGAA
GGCCCAGCATGAGCCCACCCTGC 250. chr1_MUC1_NM_002456_2.04863
CATAGGATGGTAGGTATCCCGGGCTGGAAAGATGTCCAGCTGCCCGTAGT
TCTTTCGGCGGCACTGACAGACAG 251. chr1_THBS3_NM_007112_-1.95005
CAGCTACCATCTGCCGAGACTCGCCCACAGTCAGCAGGTCAATTA 252. chr1_POU5F1P4_GU480875_1.53487
TAACCGGTGCCAGAAAGGCAAGCAATCAAGCA 253. chr1_PAQR6_NM_024897_1.64319
GGAGAGGCCGGTGCACAGGAAGGAGTTGAGTGCGGCGGCAGGCACAAAGA
ACTGGTGCAGGTGGCCGTGCAGCCAGGAGGCCGGCATGGAGTAGGCG 254. chr1_SMG5_NM_015327_1.70652
ACCCTGACCCTGCTACTCGGTGCAGGCCACTCCAGGCCTTGCTTCTCTAA
CAGCCCCTGTGGCTGGCTCCAGAGCTGCCTGGTCCCCATAAAGGGGGCTG
AAAGGAGGATGGGTGATCCTTGAGGAGGGGAAGGGTCTGCAGAGAATCAC
TCAGACACCAGGTATTACCCAGCTCTTC 255. chr1_SMG5_NM_015327_-1.56704
GAGCAGGGGCCGATCCGTGTCAAAGTTAAAGCGTCTGTGGGCAGCTCGGA
GCGGGGGCAGGTTACGAAGAGCCATGTCCT 256. chr1_C1orf85_NM_144580_1.88445
TAATTTATGGACTGGTACTCTGAGTACTTCTTGTGGTGCAGCAGCAGAAC
CAAGCCGCCCCCTAGCAGCATGAGCCCTGGGGCACCCAGGGCCACTGCCA
TGATGCCCAGGACTAGTGGGGACAAGCCGTCCACTGGAGGGAAGCCCACA

Figure 3-21

CCCAG 257. chr1_IQGAP3_NM_178229_1.63493
CCTCCCGGGTCAGGTGAGAGGTGTTGAGGGGGCAGCCAGGAGGTTGCTCC
CAGATCCCCTGGAAGGTCTGCAGATGGAAGTAGTAGGCAGTGCCATCCTT
CATGTCATGTTGAACCCAGAAAGCTGTGT 258. chr1_IQGAP3_NM_178229_-1.64255
TGAGTTAGGTAGTGGTCATAGATGT 259. chr1_BCAN_NM_198427_-1.50729
CCAAGGCTCAACTGCCCTCTCTATCCTACTCCTTTTCTT 260. chr1_NES_NM_006617_-1.68783
ATTCTTCTGACAGGTCAGAGTCACGGCCACACTCCTCTTCTCCCTCCTCC
CCCTCCTCCTTTTCTGAGGGTGGGGCCTCAAGGCCCTCGGAAGCCAGGAC
AGCA 261. chr1_NES_NM_006617_1.56094
ACTTCTGGAGATCTCAGTGGCTCTTGATTCTCCTTTTCCAGAGCTGTCAA
TGACTCTAAGTTCTCTTGCAGA 262. chr1_C1orf66_NM_015997_-1.8072
GGCCCAGGAGAACCGTGTGGTGGCCTTCTT 263. chr1_HDGF_NM_004494_-1.88582
TGCCTCCTTGGGACGTTTAGGAGAG 264. chr1_INSRR_NM_014215_1.58918
AACTCAATGCATTCCCGTGGGCTGGCCAGCTCATTCACCGTCTTCAGGGC
CACGGGTGTGGACTCCTCTCCAGCCTCAAGTCCTCGTGCCAGCCCCTCAT
ATACCATCCCAAAAGAGCCCTGGCCCAGTTCCCGGATTATCGAGATCTGC
TCCCGAGGCAC 265. chr1_NTRK1_NM_001012331_-1.57078
TGCAGTGTCATGGGCAAGGGCCCCTGGCCCACATGCCCAATGCCAG 266. chr1_C1orf92_NM_144702_-1.8477
CTTCTGGCGCGGTGACCAAAAAGGGAGAGCGCGCGGCCAAAGAGAAGCCA
GCGACCGTTCTGCCTCCCGTG 267. chr1_FCRL5_NM_031281_1.69975
CAGTAGAGCAGCAGTGCCCCCGCAGCAAGGCCTGCTATGCTGAGCAGGCC
CCCGGCGACTCCTGTGGCAAAAGGGCCACTTCTGTTCGCGGTCA 268. chr1_OR6N1_NM_001005185_1.50843
AGACGTATCAGTGCAAGCCAAACTCAGCACAGGAGGGAAGTCACAAAAGA
CGTGCTGAATGCGATTGGGGCCACAGAATGGGAGGCGTGAAATCAA 269. chr1_CADM3_NM_021189_-1.62915
AGGAACCCAGAAACGGGATGGTTGTCGGCAAAGGTTGGGAGTGGCT 270. chr1_DARC_NM_001122951_-2.00183
CGGAGCTCTCCCCCTCAACTGAGAAC

Figure 3-22

271. chr1_IGSF9_ENST00000198587_-1.58205
CCGCACCGCTCGGCTCCACTCTCGCC 272. chr1_DCAF8_NR_028103_1.5063
GGTGATGGCGTCTCTGTCTCAGGTGATGCATAAGGAACCACAGCATGTGA
CTATCAAACAGGTCAGTTTGGTGCAAGCT 273. chr1_LY9_NM_002348_1.60679
TCTGTGAAGGTGTCTGAGAACTTCTCCTGTAACATCACTCTAATGTGCTC
CGTGAAGGGGGCAGAGAAAAGTGTTCTGTACAGCTGGACCCCAAGGGAAC
CCCATGCTTCTGAGTCCAATGGAGGCTCCATTCTTACCGTCTCCCGAACA
CCATGTGACCCAGACCTGCCATACATCTG 274. chr1_F11R_NM_016946_-1.72057
GCCAGAGTCCGGTAGCACCTGAGTAAGGCAAATGCAGATGATAGGCGGTG
AGCCGACCAGGC 275. chr1_ARHGAP30_NM_001025598_-1.72187
AAGACGACTCCGGGATCCAGACCCTTCTGCACCTTCAGATGGGAGCTCCA 276. chr1_ARHGAP30_NM_001025598_-1.69378
CCAAGAGAACAGGGGCATAGACAGCCGTCTGGACTGGGCT 277. chr1_UAP1_NM_003115_-1.63338
AACATTAATGACCTCAAACTCACGTTGTC 278. chr1_RGS5_NM_003617_1.87753
TTTGTCCAGGGAATCACGCCACTGC 279. chr1_FMO9P_NR_002925_1.60447
CATAGCTATGTCAATGTCCAGGGAAGCATTTTTAAATAGTAAATCAGAAA
CATGTAAACTAGTGAATACAATTTTCTATTTTTCATTCAGAAATTTGTTG
TCATAGATGCAGCCTTTATCTGGAAATCAGTGGGCAGCTCTGGTCAAGCA
CAGCATGGCGACCACTG 280. chr1_MGC4473_NR_024160_-1.50181
CCATTGGTCACTTAAGAGCACTAACCCCTCCCTGGTTTGAAGATGTTCTT
GACTTTAAATACAAACATCTGATATTCCAGCTTAGACTCCTCCACAAGAA
CTAGAGTGTCATCCTATTTTGGCTTCCAGCTCAGTCCCTCTGCTACAAGT
CTTGA 281. chr1_F5_NM_000130_-1.83401
TGGGGAAAGGGACATCTGACCAAAGTTTGGGGAAAGATCTGTCTCAC 282. chr1_F5_NM_000130_-1.51534
GGTCATCACGTTTCACCTCATCAGGATTTTCACAAAACTTGTTGATGTTG
TCCTCAAGGTACCAGCTTTTGTTCTCATCAAACACAGCAAACACAGCCTG
CTGTTCGATGTCTGCT 283. chr1_F5_NM_000130_1.69
GCTCAGGTCGGTAGCTCCAACTGATGCCCTGAGCAGCCACGTAGAACTGC
CTTAGCTGTGCCGCTTCTGTCCCTTGGCTCCCCCAGCCTACCCAGCTGGT
GCCCAAGA 284. chr1_PIGC_ENST00000367728_-1.58634

Figure 3-23

AGCCCGGGAATCTTAAGGCCGCCGCCGGGGTTGGAGGGTCTGCGACGCCC
AAAAGGGCAGCGCCCGCCCGCAGAGTGGGGCTGGGAGGGGACGGGGTAGG
GTAGGGTGACCCCAGGGTGCGCCTTCACTCTTCTGGCACCCCATTTGGCT
TTTTGG 285. chr1_TNFSF18_NM_005092_1.53468
TAGGAGATGAATTGGGGATTTGCTAGTAAAATGATAC 286. chr1_RASAL2_NM_170692_-1.64474
CACCGTCTGTCTTGTGGTCAGTCACCCTACACCGAGACAACAACGTGGGA
GCGGAAGTATTGCATCCTCACAGACAGCCAGTTGGTATTGCTCAACAAGG
AGA 287. chr1_FAM163A_NM_173509_-1.85161
TGATGAATGACCCTCCAACAGCCCCACATGGGTTGTTTCTGT 288. chr1_TOR1AIP2_NM_022347_1.53078
AATCGTAAAACTGTTAGTATCAGGAGAGCCCTTCGAGTATTCTCTCCGCT
CCACACCG 289. chr1_---_---_-1.50703
GTGTGGCAGTCCATCCATCTGTCAGCAGCCACTGCGGGCCTACTTGCTGG
GTGCCCAGCACCGCACTCACCACTGCAGGCGTGGCCAGGAGCGTGAGATC
CCCAGAGCCCATGGCCAGTGAGAGGCGGCCAGGGATAGGTACCCAGGGTA
TGCCACAGGAGTTTGCTGGGCTCACGGAGCTCTTTCACTGGTCAGAGA 290. chr1_IER5_NM_016545_1.53815
GCGCGTCACCAGAGTCGTTTCTCTTCGGAGTCTTAGGTGATCGAGGGTGT
GCCCAGGGGGCGGACTTGTTTGCGCCTCCCGTTCCCTCCCAATTTCCAAA
CGTGTCA 291. chr1_CACNA1E_NM_000721_1.60184
GCGCCAGCAGCAGATTGAGCGTGAGCTGAATGGCTACCGTGCCTGGATAG
ACAAAGCAG 292. chr1_CACNA1E_NM_000721_1.71496
ACATGGGCCGGGTCATCAGCCAGAGCGAGCCTGACCTCTCCTGCATCACG
GCCAACACGGACAAGGCCACCACCGAGAGCACCAGCGTCACCGTCGCCA 293. chr1_GLUL_NM_002065_1.72196
GGAGGCCGCAGTACTGCTCACACGCTCC 294. chr1_RGSL1_NM_001137669_1.64498
CAATCAACCACTAGGAGGGAGATCCTGAGCCACATGCAGAAAGTGGCTCT
GTTCAAACTCCAGAGCTATTGGCTTCCCAACTTTTACACCCACACCAAGA
TGACCATGGCCAAGGAGGAAGCATGCCATGGTCTGATGCAAGAGTACGAG
ACTCGCTTATACAGCGTTTGCTACACCCACATAGGAGGGCTCCCTCTGAA
CATGAGCATCAAGAAGTGCCACCACTTTCAGAAACGGTACTCAAGCAGGA 295. chr1_LAMC1_NM_002293_1.62817
GCACTCGGGCACGCGCTCGGAAGTCGGGGGTCGGCGCGGAGTGCAGGCTG
CTCCCGGGGTAGGTGAGGGAAGCGCGGAGGCGGCGCGCGGGGGCAGTGGT
CGGCGAGCAGCGCGGTCCTCGCTAGGGGCGCCCACCCGTCAGTCTCTCCG
GCGCGAGCCGCCGCCACCGCCCGCGCCGGAGTCAGGCCCCTGGGCCCCCA
GGCTCAAGCAGCGAAGCGGCCTCCGGGGGACGCCGCTAGGCGAGAGGAAC

Figure 3-24

GCGCCGGTGCCCTTGCCTTCGCCGTGACCCAGCGTG 296. chr1_LAMC2_NM_005562_1.65386
CCTGGCCCAGCAGTTGACAAGGGAGGCCACTCAAGCGGAAATTGAAGCAG
ATAGGTCTTATCAGCACAGTCTCCGCCTCCTGGATTCAGTGTCTCGGCTT
CA 297. chr1_SMG7_NM_173156_-1.6672
CGCCAGCACCCGCGGTGCCGCGGGGCCGCTCCGAGGAGCCTGAGAGACCC
ACGGAGGCTTCGCGGGAAGACGC 298. chr1_NCF2_NM_000433_1.54595
GGCTTTGGAACTAGGAGGAGCTGGGATGTCGGACTGCGGAGAGCTTTCCT
C 299. chr1_B3GALT2_NM_003783_-1.50362
AAAGATGCTATCGAACATGCGCACATCCCCCAACAGTCTGCCTCCTGCGA
TTGCTTTTCACAGTATCCAAAGTGTCCATCTGTCTGCTTGTCTTCGAGTT
ACCCTCCTTGTTCATATGGGTCCTAGTCTTCTGAAATTTTCCCTTTCTTT
CATTTTCTCTCTTTCGTTAAACAAAAGAGCTGTAGTTGCCCGTTCTGCTT
GTAGCACTGTTGACTCTTCCCGACAGTTGATGCATTGAAGCTTTTTACAT
CTGCTATTTTCCTGGCTGGACAATGCAGTGCTGTGTTCTCGTCTCA 300. chr1_NEK7_NM_133494_-1.51326
TATAAAACCAGCTAATGTGTTCATTACAGCCACTGGGGTGGTAAAACTTG
GAGATCTTGGGCTTGGCCGGTTTTTCAGCTCAAAA 301. chr1_CACNA1S_NM_000069_-1.69708
ATGGGCACGGCCTTCTCTTTCAGCTGCAGCTCAGCCAGGGGACGTGGTCG
GGGGCTCAGCGGGATCTCAGGCTCATCTTCCTCGT 302. chr1_CACNA1S_NM_000069_-1.50908
TTGCCACAGACGAAAAGGATGATGAAGTAAATGCACACAAGCATGCCAGG
GTAGGACGGCCCGCCGTAGGCCATGATCCCATTGTA 303. chr1_CACNA1S_NM_000069_-1.52931
AGAAGGATCCCAGCAAAATGAGGG 304. chr1_CACNA1S_NM_000069_1.68205
CAATGCCCCCGCCTTGGGGACTAGGCTG 305. chr1_IGFN1_ENST00000412892_-1.69711
CACAGTGAAGGCTCCGTGCTACCGGGAGCCCGACCTGAGCCAGAAGCCCC
GGTTCCTGGTGGGCCTGCGGTCCCACCTGCTGCCCCAGGGCTGCGAGTGC
TGCATGAGCTGTGCCGTGCAGGGCTCGCCCCGGCCCCACGTCACCTGGTT
CAAGAATGACCGCAGCCTGGAAGGAAACCCCGCGGTGTACAGCACTGACC
TGCTGGGCGTGTGCTCCCTCACCAT 306. chr1_LAD1_NM_005558_1.52523
CCGACTCAGTCTCCGGCGAGGTGGGATTTCCAGTTCCTTCTTGGAGACTA
GGGGTTTCTGTGTGGCCTGCACAGGGCTCAAGCTGTTCCTCCCCTCCTCT
GCCTCCAGCCTCTCCTGGATGGGGGCCTGTGCAGCCTCCACCACCTGCCG
CCTCTGCCTCCGCTCCTGCCGTGTTCTGAGGATGCTCTGGATGTCCTCGT
CCTCATCTTTGGAGGCTGGG

Figure 3-25

307. chr1_PRELP_NM_002725_1.53319
ATTCCCATCGTGAGTGAGCCCAGGTGAGGACATAGTCGGCTCCCGTTTGT
TGTAGGCCCTTCCCAGGTGCCTTCTCAGCTCCCTCATCTGTAAACCGAGG
AGGTGGATAAGATGCTCCCGGCCGGGCGCGGTGGCTCACGCCTGTAATCC
CAGCACTTTGGGAGGCCGAGGCGGGCAGATTATTGCCTGAGCTCAGGAGT
TCGAAACCACCCTGGGCAACATGGTGAAACCCCCGTCTCTACTAAAATAC
AAAAAAATTAGCCAGGCATAGTGGCGCGCGCCTATAATCCCAGCTACTGG
GAGGCTGAGGCGGGAGAATCGCTTGAGCCGGGGAGGCGGAGGTTGCAGTG
AGGCGAGATTGTGCCACTGCACTCCAGCTTGGGCGACAGAGTGAGACTCC
GTCTCAAAAAAGAAAAAAAAAAAGATGCTCCTCTGAGGTCCCTCCGGCGCT
CATGTTCCGAGTCTGCAGCTCCACACTTTAAATCATACTCGAATGCAGGA
CAAGTCCTAAATATTTGCCCCTTCCCTTGCAGTAATTTATTTTCTGTATG
GACTGTCCCTCCCCCAGAGGCTTCCCCACCCTCCATTGCCTGGCCCAGGT
GAGCAGCTTGGCAGGTCTCCAAGTGGAACCCGGTCCAGACAGGGCTGCCT
CGACTTCACCTTTCCCCCTAACTTCCTCCAAGGGATGCTGCCCCTTCTCA
GCCCCCTGCGTGTGTATATTGGTGGGAGGCATAGAGGATGGATGTTCTAG
AAATGAGTAAGACACAGTGCCCACCCCCAAGTTAGGATGAAAAAAGTTCC
AGAGGTTTTTAAGAAATTGGATTAAGCTGGGTCCCTAACTTCAAGAAATT
CCCATTATGCTCCTTCTCACCTTTCTTTTTTGCTAATTATGGAAAATAGG
GCCCATTTCATCATAGCCTCCTTCCCCCGTGCTCCACTACAATCGCCGCA
TTCTTTCTAGCTGCAGCTGGTTTCTTCAAGGCTCCTGCTTAAAGTCCACA
CGTTATTATGGCCGAAAGCAACCTGGTGCTTCGGCCTGGATAAGAGCCCC
TTCTGCATCTTATTCACAGCTTGCAGCCTCAGCCCCTTTGATGAGGCCCT
CAGGGGAGAGGTCATTACCTTGATCCTGCAAACCCAGACTCGTTG 308. chr1_REN_NM_000537_1.65042
AGGAGGGCACCCAAACATTGGACGAACCAGTGTCAAAGACGACTTTGAAG
GTCTGGGGTGGGGTGCCGATGCCAATCTCGCCATAGTACTGGGT 309. chr1_PLEKHA6_NM_014935_1.89032
GAAGATCGGTGGAATCCTCCCAGGCTGTAATCCCTCAGAAACATGAGAAT
ATCCTAAGCACCTACAACAGTGCCTGGTACATAAAAGGTGCTCGATAAAT
ATTTGTTGAGTAAATTGTCATCTTTACTTGCATATGAACCAGTAACTGTC
CCAGCCATGAAGGAGTGCAGAGGAATTAGTAGGTGTTCTTGGGACCGCTG
GAAGTCAGGCTGAAGCCTCTGAGCGGCAACTCTAGCAGAGAGAAGGCCGA
GGGGCCACGGTGTCTTCAGTTTCCCTCCTTCCTCCTCTCTGGCTACATTC
GTCTCCAGGTGGGTGGAGCTGAGGAGGAATGCGTTTGCTTTTCTCTGTCT
TCCCCGCTGCCCTCCCGGGGCAGGTGGATCATGAGAGCGCCTAGCCTCAG
CCAGTCCTCGTCTGGGATGCCTGGGATAGGGGGATAGGCCTCCCAGATTA
AGGCCTCATCCCCCCTCCTCAAGGCGTACTCTCAGCTGGCCCACTGCACA
TTCCAGGGGGGAACAGGGCAAGAAATATCATGGAACTGGGTAGGTAAGGCC
CCAAGGCTGACCACACCCTACATAAGACAAGTCCTTCTCTCTGCCCCTTA
CCCCAGGATGGCGAGGCAGACACCAGGCACAGACCTACTAACAGCCATCT
CCCAGGCAGTCGCTACTCAACCCCCTTCACCCAGATCCCCACACCAAGCA
TCTCCACTGAGGCTGCATGTGCTCCACTGGTGGGTCCTCCTAGGGATGAG
GTGGGAGGAGCAGAGGAGACAGTCTGGCACTGCACTGGGCACTAACCTAA
GGCTCCACCGGGGGAAACCAATCTGATATCCCCTTTCCATCTCCCTCCTT
CCTGCTTGACTTGCCAATGTGTCCTGCTGCTTCCCCCTCCTTCCACTCTG
AGGATCTCTCTCTCTCTCTCTCTCTCTCTCTCTCTTTCTGTCTCTCTCTC
TGCTACCCTTCCCAACCTGCCCTCAGACACTGCACAGACCTGCTGTTCTC
TAGCCACAGCCAGCACTGTTCCCTCTGGGAGCCAATGGCCTCTCCCCATC
TCTCATCACCTTGTCTTTGGCTCAAGCAGGGTGGTCAGTCTCCACCGGAC
CCCAGCGAGCACCCATAAGCAAAGCACTGGGTTTGTGTCAAAGCCCTGGG
TCCAGCTGAGGCAGTAGGGTGGGGCTGACGAGGATAGGGATGATGACAAG
TGCTGTCCTTGGTGTCAGGCTGGCTCCAGAGGCAGTGTCCATCTCCTCTT

Figure 3-26

CACCTCTAGTCCTCACATAAGATAGCCACAGGTGTGTTCTCCACCACGGC
ATGTCCCCCATCAGGGAATGTTCCACTGGAGTCACCACAACCCCAGCCAG
GGCAAGGCTGAGGCTCCCTGTGACTTGGACATTAATGAGGATGGTGCTCC
CC 310. chr1_PLEKHA6_NM_014935_-1.60138
CTGCCTCTACCTCTTGCCTGGTGGGCACAAGGCTGATGTCTCTGGGGGTG
TCCAGGGGCAATGTCTGGTGGGGGTCTTTCTTGCTTTGTTCATAGTTTGC
CTTGG 311. chr1_NFASC_NM_001005388_-1.68565
TGAATGCCACCTCGGCCTTTGGCCCCAACCTGCGCTACATTGTCAAGTGG
AGGCGGAGAGAGACTCGAGAGGCCTGGAACAACGTCACAGTGTGGGGCTC
TCGCTACGTGGTGGGGCAGACCCCAGTCTACGTGCCCTATGAGATCCGAG
TCCAGGCTGAAAATGACTTCGGGAAGGGCCCTGAGCCAGAGTCCGTCATC
GGTTA 312. chr1_CNTN2_NM_005076_-1.93825
GCGGGGGAGAGATCCTTATCCCCTGCCAG 313. chr1_TMCC2_ENST00000330675_-1.58053
TGAACCAGGTTGTTCAGCCCTTAATGAGCAGACACTCTGCATGTAGAG 314. chr1_SLC26A9_NM_052934_1.54099
TTGCCTGGGCAAAGAGGACTGCGTCATGTATGCTGGGAAAGACGTGCTTG
CATTCTAGACTCCCA 315. chr1_IKBKE_NM_014002_1.59217
AGGAACCACCTGCGCCTGGTTGGCTGTTCTGTGGCTGCCTGTAACACAGA
AGCCCAG 316. chr1_LGTN_NM_006893_-1.60914
CAGCAGGGGGCATCACCAGTCCAGGC 317. chr1_DYRK3_ENST00000367106_1.62428
CCTAGATCGGGGTATATGTTAAGGGATTACGAAAATCTAGGACTTTTTGT
GGGGCTTTTTATTAAAGGGGGGGAGCCCGGGAGCAATACCTTGGAAAGAA
GCCCTGTTGCTTAGAGCGGATAACCAACGGCTGAACTCTTGGGGTTTGC 318. chr1_PIGR_NM_002644_-1.84534
CCCGAGCGCCGCACCACTCAGGCCGACTTCTCCTGTGCAAT 319. chr1_CD55_NM_001114752_-2.96656
TGGTATGCGGTGGTGTGATCGTAG 320. chr1_CD46_NM_002389_-1.64987
CTGGCGCTTTCCTGGGTTGCTTCT 321. chr1_CD46_NM_002389_-1.71319
AGTAATTTGTGTTGTCCCGTACAG 322. chr1_PLXNA2_NM_025179_-1.59419
ACAGATTCTTTGCCATTGAATTTGACTCGGATCCTTGGCTCCTGAATGA 323. chr1_CAMK1G_NM_020439_-2.90371

Figure 3-27

GGACATCTATGAGAGCACCACCCA 324. chr1_TRAF3IP3_NM_025228_1.58977
GGCTTTGCCCGTGTGGAGTCCAAAGTCCTTCCCTAACGAAGTGGAGCCTG
AG 325. chr1_RCOR3_NM_001136223_-1.74582
TACTGGGGAAGAACCGATCGGCCAACGGCAGCGCCAAGAGCCCGGCAGGC
GGCGGCGGCAGCGGCGCCTCGTCCACCAACGGCGGGCTGCACTACTCAGA
GCCCGAGAGCGGCTGCAGCAGCGACGACGAGCACG 326. chr1_INTS7_NM_015434_-1.5333
CATCCAGTTCCTGTTCGCCATAGCCGGCAT 327. chr1_DTL_NM_016448_-1.86389
TGCTCTTCAATTCGGTGCTCCGCCAGCCCCAGCTTGGCGTCCTGAGAAAT
G 328. chr1_ATF3_NM_001674_-1.68623
GCGCGCACTGCACAGCTCTCTTCTCTCGCCGCCGCCCGAGCGCACCCTTC
AGCCCGCGCGCCGGCCGTGAGTCCTCGGTGCTCGCCCCGCCGGCCAGACAA
ACAGCC 329. chr1_USH2A_NM_206933_1.5588
TGCTCCTGTTGTACGTCCTCGACTCCAATCACTATATACTGAACCTCCTT
CATGCGAGGCTATCACTCGATAC 330. chr1_MARK1_NM_018650_1.65373
CGCCGGGGCCGCTTGTTGCACCGCCCCGCGGCCTGCGGGAGCCGCTCGCC
CCGGCCTTGTGCTCGCGTCCGCACCCCTTTC 331. chr1_MARK1_NM_018650_-1.51347
CCGGACGCCATTGCCGACGGTGAACGAGCGGGACACGGAA 332. chr1_MARK1_NM_018650_-1.55067
TGCTGCTCCCGAGCTTTTCCAAGGAAAGAAGTATGATGGGCCTGAAGTGG
ATGTGTGGAGTCTGGGCGTCATTCTCTATACATTAGTCAGTGGCTCCTTG
CCTTTCGATGGCCAGAATTTA 333. chr1_C1orf65_NM_152610_1.67318
GGAGGTCTCAGGCCCCTTGGGCAGACGCTGCGCGTGCCCAGAGGGAGG 334. chr1_TP53BP2_NM_001031685_1.54605
CTGTATTTTCATCGGCCCCTCTGAAGCCTGAATGACCAAGGAACCATCCG
GCAGGGCTGGCTTCACCAGCAATTCAGGCCTTGAGGGCATCCGAGGCATA
GTAGACGACTGGATATAGGGACCTACTG 335. chr1_TMEM63A_NM_014698_1.69796
GCTGGATGCCAGCGGGACCTCAGACCTGGACTGCAGCATCTCTTTGGTTA
TCGGTTGTGTGTGTGCTCAGAAGGGAGGAGGCCTTCCCCTTGTTACATCT
CTCTCTCCATATATTCTCCCGGACTCATCAGTTTGGGGGGCGAAAAGTCC
ACCACATGGTCTTGGCGACAAA 336. chr1_TMEM63A_NM_014698_-1.73282
GCAGACGGAAGATGGCAGTCAGCC

Figure 3-28

337. chr1_PYCR2_NM_013328_1.67588
ATGGGTGCCCGTGGCGTACACTGTAGCGCCTTCCTGCACTACCACAGGTG
TGTTGGTCATGCAGCGAATCACTTTGGG 338. chr1_ACBD3_NM_022735_1.55344
CGCGACCGGATCCAGGTGGCGAGGGCGGTGGCAGCGGTGGCGGCAGCAGC
GGGGCGCCCTCCGCCCCAGGCCGCTCCTCCGGGTCCGGGCTGAGCGTGAG
GCCGTCGACGGACAC 339. chr1_WNT9A_NM_003395_1.83311
TCGGGTGCCTCATCGCAGGTACAGCGCTCCATGCGGCCCGCGCTGCACGC
CTTGGCCAGTGCGTGCGTCAGGCCAGCCGAGGAGATGG 340. chr1_C1orf35_NM_024319_-1.58168
TGCTTTCCGTCTGATCCTCCGCCCGCGGCTTCCTCCTGGCCGAGGCTGCC
GAGGTCCCGGGCCCGCCGCTCTCTACGCGGTGATG 341. chr1_OBSCN_NM_052843_-1.71786
TGGCAGCTGGACTCGTGACGGTCTGCGGTTCCAGCAGGGGCCCACGTGCC
ACCTGGCTGTGCGGGGCCCCATGCACACCCTCACACTCTCGGGGCTGCGG
CCAGAGGATAGTGGCCTTATGGTCTTCAAGGCCGAAGGAGTGCACACGT 342. chr1_OBSCN_NM_052843_1.54075
CAGACAGAACTGCGCGCTGCTGGAGCAGGCCTATGCCGTGGTGTCTGCCC
TGCCACAGCGCGCTGAGAACAAGCTGCACGTGTCCCTCATGGA 343. chr1_TRIM17_NM_016102_-1.71487
GGACCCATCGCTTACACTGTAGAAGGACACTTCCCCGGCTTCGAAGTCCA
GGAAGATGCCCATGTGGCTGGGAGGCTCCATCAGCATGACCGGGGTTAGG
GCAGAGAAGGTGGATAAGTACTTGGTCCCCTTGGACAGCTGCACCACCCA
GAAGCCGTTTTCGGGGCACTTGGGGACCCTGTCTTTCCGGCTCACGTTGT
CCCTGCACACACCCAGGGCCCACAACGCGTCCCCGGTGATGTTCATGCCC
ACCTCCCAGTAGTGCCTCCCAGAGGAGAAGGCCGTCTGGCCCACAGCACA
GGGGTAAGCCACAAATCGGTCCTTGCTGCAGAACCCACTGCCCTCCGGCG
AAGAGCCGAGGTAGCGCCTCTGGCGGCTCTCATACAGGAGGA 344. chr1_EDARADD_NM_080738_-1.612
TGAGCTCGTGGAAGAAGCGAAGGAGGAGAAGAAGAAGGGAGGGGAAGGCG
GAGGAGGGCAGGGGCGCGCAGAGCCACGGTTTGCTCCAGGCGCGTCGGAA
CCGCAG 345. chr1_MTR_NM_000254_-1.50152
TTCGCCGAGAACTGTGGGCCTACTGTGGCAGTGAGCAGCTGGACGTCGCA
GACCTGCGCAGGCTGCGGTACAAGGGCATCCGCCCGGCTCCTGGCTACCC
CAGCCAGCCCGACCACACCGAGAAGCTCACCATGTGGAGACTCGCAGACA
TCGA 346. chr1_RYR2_NM_001035_-1.55471
TTGTCAGGCATAGGATTTCACTAT 347. chr1_HNRNPU_NM_031844_1.80462
CAGCAGGCTAAGGAGATACCCATTCAAGAACTGACATGATTAAAAATTAA
GATATAAATGGGTGACTCACAATTTCATTAGCTTACAAAGATGGTGGAGT
TAACTACTACAAGCACACTAGTTATACAGTATTTTGTGGGAGAAGGGCAT

Figure 3-29

ACAGACATGGCTA 348. chr1_SCCPDH_NM_016002_1.79195
GCGACCGAGCAGAGGCCTTTCCACCTGGTGGTGTTCGGCGCGTCTGGCTT
CACCGGCCAGTTCGTGACCGAGGAGGTGGCCCGGGAGCAGGTGGACCCGG
AGCGGAGCTCCCGCCTGCC 349. chr1_ZNF669_NM_024804_1.52905
TTGCCCAGGTTGTTTCACATTGTTT 350. chr1_NLRP3_NM_004895_-1.63333
ACCTCACGTCACACTGCTGCTGGGATCTTTCCACACTTCTGACCTCCAGC
CAGAGCCTGCGAAAGCTGAGCCTGGGCAACAATGACCTGGGCGACCT 351. chr1_OR9H1P_AY358215_-1.53458
GGGTAGTAGGCTGATTTCATCTAGATAATTCCGGTCAACCACCCCAGCCA
ACACTGTAACTCCCTTCTTAGCCTGTTGACTTAAGAATAGGAGGAGAACA
AAGTGTCCAGGGGGCAATCTTAACTTCCAGTTTAATGGAATTTTTGTTGG
GTCTCCTGGTGGCAGTGCTCCTCCCTCTGGAACTAAGACCTCTAGGCCAG
CAGAAGATAATGTTG 352. chr1_TRIM58_NM_015431_1.61683
TGTAAAGCTGGATCCCGCCACGGCGCACCCGAGTCTGCTCTTGACCGCCG
ACCTGCGCAGTGTGCAGGATGGAGAACCATGGAGGGATGTCCCCAACAAC
CCTGAGCGATTTGACACATGGCCCTGCATC 353. chr1_OR2T12_NM_001004692_-1.72035
GGCCTCATTTTGCTGGTGTTTTAGG 354. chr1_ZNF672_NM_024836_-1.58401
CACAAGAGGAGGACATCCCATGCGGCTACTCCTGCCCAGCGT 355. chr2_MYT1L_NM_015025_1.53525
ATGAGAAGCATAATTGCCGGTGATATGTCCAGAACCATCACAGCCAGGCG
TGGGGCA 356. chr2_MYT1L_NM_015025_1.88847
TTCTGGAGGGACCCTATCTTTGTGCGGGCATCCGGACAGGCTGCGGTGAT
GTGGGTACAGCCCAGTTACGTGGCCGGTTC 357. chr2_TSSC1_NM_003310_1.59692
CCAGGGTCTTCACGGGTTCGGTGACATTTCGGGTGTCCCAGAACTTCACC
TTACAGTCGTCTCCGCAGCTGGCCAAGTAGTACTGCTTATTGGGATTAAA
GTCAAGGTCCCGCACCAG 358. chr2_TTC15_NM_016030_1.68554
GAGGACGCGGCACCCAGTAGCGGAGGGGCCCCGAGGCAGGACGCGGCCCG
CGAGGTCCCAGGCAGCGAAGCCGCGCGCCCGGAGCAGGAGCCTCCCGTTG
CGGAGCCGGTCCCGGTGTGCACCATCTTCA 359. chr2_SOX11_NM_003108_1.63354
GCAGCCGCCTCTACTACAGCTTCAAGAACATCACCAAGCAGCACCCGCCG
CCGCTCGCGCAGCCCGCGCTGTCGCCCGCGTCCTCGCGCTCG 360. chr2_CMPK2_NM_207315_1.69307

Figure 3-30

TGGCCGCCCGGGCAGTAGCAGAGCAGCCT 361. chr2_RSAD2_NM_080657_-1.55573
AGAGCCATTTCTTCAAGACCGGGGAGAATACCTGGGCAAGTTGGTGAGGT
TCTGCAAAGTAGAGTTGCGGCTGCCCAGCGTGAGCATCGTGAGCAATGGA
AGCCTGATCCGGGAGAGGTGGTTCCAGAATTAT 362. chr2_ASAP2_NM_003887_1.50833
AGGAACACGCCAAGCTCCATGGGATGATTCGGACTGAAATAAGCGGAGCG
GAAATTGCCGAAGA 363. chr2_ASAP2_NM_003887_2.27085
AAAATCCCACTGGCCAACGGACAT 364. chr2_ASAP2_NM_003887_-1.71023
GACAGCCTCCTCTGCTAACACCCTGTGGAAGACAAACTCTGTAAGTGTGG
ACGGTGGAAGCCGGCAGCGATCTTCGTCAGATCCGCCAGCTGTCCATCCA
CCG 365. chr2_HPCAL1_NM_002149_1.71281
CTGACGGGCGCCTCCACCTTGCTCCCTCCCTGGCTGCCGGCTTCCTTTTG
TCTTTCTGGGCGGCGATGAGCGCAGGGCCGGCGCAGCAGCTGCGGGCGCA
CGGAGGCCCGCGCTGCTAGTCACTCCTCCCGGCCTCGGCGCGCTTGTCCC
GGGCAGCGGCCCGGGCCCGCTGCAGCCGCCGCCGGCGCCGAACTTGGGCT
CGGGAAGC 366. chr2_HPCAL1_NM_134421_1.55652
CGCGGAGGCGATCCGCTCGTTCCTCCCAGGGCCATGGGGCGACGAGGAGA
GCCCTGGCCTCCCCGCGACCCGCACTGCGACCTGGGCCAGACGCGCCACC
TTCCCCGGTCGCGGTTTGCTTCTCTTTAAAATGAGGACAGCTCCTCCCTT
GGGGGCTGTGGTGACAGGTGAAATGAGAACGCACTGAAGACAGCTCTTGG
TCCAAAGCCCCGCACA 367. chr2_ATP6V1C2_AK127836_-1.53693
TCTTAAATTTGAGGAGCCGGAATCATGCCTTCCTCCTAATCTGCAGGGCC
TCTTTGGAGCTGCCCCCGCCAGCAGTGAAGGGTGCTTGTCGGCCAGGGCG
CCTCTCCCCGGGCGCCTGGCTGGAGGTGGCTGGAGCTGGGACGGGCAGGG
CCCTGGCTGGGGTGGTGGTTGGCAGCTCAGCTCTCCTCCCTTGGCTGCCC
TTGCTGAACCCACCCCTGACCTTTGTGGGCAGCTGCAGTGTCAGGCGGGA
GCTCGGGGCTCTTGCTCCAAGACTCTTGAGCTCCCAGGAAG 368. chr2_GREB1_NM_014668_-1.61911
GTCATCTGTCAGGACCGGAGCTCACTGCGCCAGACGGTCGTCCGCCTGGA
GCTCGAGGACGAGTGGCAGTTCCGGCTGCGCGATGAGTTCCAGACCGCCA
ATGCCAGGGAAGACCGGCCGCTCTTTTTCTGACGGGACGACACATCTGA 369. chr2_RDH14_NM_020905_1.68789
TCCAGCTCCCGGACTATGAGCTCGCCCACCCCGCTGACGCCAGGCTCTGG
GCCGCACTCCGCGGCCTGGCGGAGCTCGCGGCGGAGCTGACCCGCCGCCT
CCTCGGCGCGCGCGCGGTCCCGGCAGCCCATGATCACCCGCGCTCCCAGG
CGCAGTAGCTCGGCGGCCGTGGCGCGGCCCAGGCCGCTGTTCGCCCCGGT
GATCAGCACAGTCTTCCCGTGCATGAGG 370. chr2_HS1BP3_NM_022460_1.53563
GAAAGGCCACTGACCAAGTCCAGACCCTGAGGACGACGAAGGCCTCGGGG

Figure 3-31

CAGAAGCCTGAGAGAATCATGCCCCACTGGCAGTGGGAGGCGGTGCAGGC
TGGGAGCCCTGCCCAGGCCCCAGGCTGAGCTGTGGGGAAAGCTATGACCC
AGTTTGCTGAGAGCTGCAATGACGAACATTGGCTCTG 371. chr2_HS1BP3_NM_022460_-2.08402
GTCCACGGATGACACGTCCTCCGAGGGGTCCTGTGGAGACAGCTTCCTGC
CCGGGCCAAAGAGCCCCTCATCAGGGTCCACCTCCTCGTCAAAGATGGTG
AGCCGGG 372. chr2_APOB_NM_000384_-1.57163
GAGAGTCTACCTCAAAGCGTGCAGTCAGTGCTTGAAAGGAAGGAATGACA
ATTCCAGCAGGTACAGAGAACTTAATGGAGGGAATCTCAATGGTCTGCTC
AGGCACGATGATGGTGGGCAACTCAAAGTCTGCGATCTTGTTGGCTACTG
CATTTAGATCCAAAGCAGCAATGCCATCTGAAACACTTTTTGGAAGCGTG
AACTGGGACACAGTTAACTGAGATTCAGGCACGGTTATCTCAAAAAAGGG
AATCAAGGAGTCTTCTGGTTGAGAATATTTTGTTAACACATCAACTTCAG
GGAATTTTACCTCGGGGAGTGTTGGTAGGTTGAGGGCAAATGATGAAGTT
CTCAGCTTCTTATAGATTTGTATTTCTCTGAAGTCAAGTTTGCACGATGG
AACCTGAAGATCTGTAAATGGGACATGGAACGTAGGCATGACAAGAACTG
AATTTAGATCATTTAGTTTCAGCCCAGGAATAATGAATTTATCAGCCAAA
ACTTTTACAGGGATGGAGAATGAATAGCCATTGGGGTTTTTGGTGTACAC
AAAGGCAGTTGAAACACGAAGATGCTGTCTCCTACCAATGCTGGTGGTTA
CATCCAGCTTTAGGAAATCCCATAAGCTCTTGTCATAGACTGGTAGGATG
ATATTTTTGAGGAACCTTAGGTGTCCTTCTAAGGATCCTGCAATGTCAAG
GTGTGCCTTTTCTTGGTCATTGGAAAGCTCGACCTGGCTCTGGAAAGACC
CAGAATGAATCCGGACTTCATTTTTCCATCTGATCTTCTGGTTCTTAGTG
TTAGCATTCAGGGCCACTTCCTGGCCAAGGTCAGGGAAATCATGGAAGGA
ACTGGGCTGACTTGCATGGACCTGAAC 373. chr2_APOB_NM_000384_-1.54093
TTTGCAACTGTAATCCAGCTCCAGTGGGGAGTTCAAAGGCATTCTCCATG
A 374. chr2_KLHL29_NM_052920_-1.60095
GAGCTCGTCCTGTCGAACCTGCAGGCAGACGTCCTGGAGTTGCTGCTGGA
GTTTGTCTACACGGGCTCCCTGGTCATCGACTCGGCCAACGCCAAGACAC
TGCTGGAGGCGGCCAGCAAGTTCCAGTTCCACACCTTCTGCAAAGTCTGC
GTGTCCTTTCTCG 375. chr2_UBXN2A_NM_181713_1.96962
ATCTCAAAGAAGTCCTCCGTTTTC 376. chr2_CENPO_NM_024322_1.53198
GGAGCAGGCGAACCCTTTACGTCCAGATGGCGAGTCCAAAGGAG 377. chr2_ADCY3_NM_004036_-1.54045
CGCAGCATGAAGTTATTGAAGGACTGGTTGTTGATGTTGGTGAGCGTATC
CTTCATGGCCAGCGCGAAGTCGGCCAGGTCAGC 378. chr2_DNMT3A_NM_175629_1.5394
CGTACTCTGGCTCGTCATCGCCTGCTTTGGTGGCATTCTTGTCCCCAGCA
TCGGACCCCACGGGCTCAGGCGTGGTAGCCA 379. chr2_DTNB_NM_021907_-1.6479
TGTCATTCATATTAGTCAGAGGGCGAGGAG

Figure 3-32

380. chr2_GPR113_NM_001145168_-1.59315
AATGAGCAGGGCTTTGATCACCCCCAGCAGAGCTTGGCGCTTCTCTGCTG
GGGGTCCCTCTGACAGCGAAGGTCTCAGCAACTTCAGCATGGCCATGGCT
AGTACCAGCCCATTCACGCCTATGATGGCCAGCACTGGCCCCACGAAGGT
GTATAACGCCCCTCCCTTCCCATCCAACCAGCATTCCCCCTCCCTCAGGT
ATTGCCCTTGAGGTAGGTAGAGCCCCAGGGTGACACCTGCCAACCCCAGT
GGGCACAGGTAGCCCAGGAGCACCATGAGGGGGAGAACTCGGTGCTTTGC
CAGCTGGTGAAAGACAAAGAGCAGCTGGTGGGCCAACACCAGGGCCTGCG
CCAGCATCCAGAAAAAGGTGGCCAGGTAGAGGAAATGACAGAGGAAGGCG
GCAGCAAGGCAGAGCGGGCTTCGGGGCCCTGGAGAGAGGAATGGGGCGCC
CAGGAAGCAAGTGTCTGCGGCCAGCAAGCAGAACACCATGTTGAGCAGGG
CGGCGTGGCGGAAATAGGAGATCTTGTTCCGCACCACGACTCTCCACACC
AGCCAGTACACACCCAGGCACACAAGCAGCGCCAGTATGGAAGCTCCCAA
GCCCACTTGAGTCAGCAGCGCCAGAGCGGGTTCTTCCGGAACAGTGTGTG
GGGACATGAGGACGGAGAAGGCAGTGAGGTGCTGGCAGAGGCACTGAGCA
GTGGGGCTGGCACTGGCCACCTGTGCCTGGCACCCTTCTTTGGACCAACC
CCCCCTGCCCTGGAAGAGACTGTGATCCCAGAAGACACAGTGAGGGGAAC
CATCTGTGTTCCCAAAGTCCATGATGACCTCTCCCTGGCTGAAGGCCCGG
TCACCTGCCATGATGGAAATGACAAGGACCAGGCCAGGAGTGGCATAGAG
GGAATCCCCCAGCCCTTGTCCATAGTTTGAGGGCAGAAGGTGGTCCAGTT
TTCGCAGCAC 381. chr2_C2orf28_NM_080592_2.22346
GGACCGGGCCGCTTAGGCCACGCCCGGGGAAGAGGGCCTGACGCGCTGCG
GGGCGGGGCCGCGGGGCCGGGTCGCGCGAGCAGCGGAGCACCAAGGGAAC
GGAAA 382. chr2_CAD_NM_004341_-1.52671
GCCCTCACCGATCCCTCCTACAAGGCACAGATCTTAGTGCTCACCTATCC
TCTGATCGGCAACTATGGCATCCCCCCAGATGAAATGGATGAGTTCGGTC
TCTGCA 383. chr2_ZNF513_NM_144631_-1.5257
GTGCCGCAGCATGTGACGTTTGAGGTTCATGCTCTGGTTGCAGCTGTAGT
TGCAAAGGCTACACCGAAAAGGTTTGTCACCAGAGTGGATGCGACCATGA
CGCTTGAGGTTGGCCAGATTGCCACAGGCATAAGGGCAGAGGGGGCACTT
GTAGGGCTTCTCTCCTGTATGGACGCGCTGGTGCCGTTTCAGGTTATCCA
GATGAGCAGAGGC 384. chr2_NRBP1_NM_013392_-1.58349
GAGCCGGTTGACTTCTCTGCTAGAAGAGACCTTGAACAAGTTCAATTTTG
CCAGGAACAGTACCCTCAACTCAGCCGCTGTCACCGTCTCCTCTTA 385. chr2_KRTCAP3_NM_001168364_1.52402
TCTGCAGGGGAGGCTGCTCTATCTGGTTACTGCTGTGTGGCTGCACTCAC
TCTACGTGGAGTTGGGCCCTGCAGGAAGGACGGACTTCAG 386. chr2_SUPT7L_NM_014860_-1.62988
GGCAATAAGGTTGCGAAGACGTCGGTTGTGCTGAATCAACTGAATCGTAT
GGATGGTGAGACTACATGGCTCTGAGGGGATGTCCAGCATAGTGGGGGGC
TTCGGCTTGTTGGCTGAGGGTTGGTGCAGGGGTGGGTCATGGACTTCCAC
CAGACGGAACTCCCGTGGGAGCAAATCGAAGGAACTTC

Figure 3-33

CGGCGGAGATGAGAACATCGGCACCGTTACCACCCTGGCGA 388. chr2_LCLAT1_NM_182551_2.21577
GAAAAACAGAGTGGGTACTCTCTTCTGGGAAGCTGGCAACAAATGGA 389. chr2_GALNT14_NM_024572_-1.96877
GTGCAGGGCGACCCGAAACGTGGCAGGGAAGGACCGAGGGCAGCCAAGCT
GGACGCCCGCTCCAGCGGGAGAAGCGCGGTGG 390. chr2_SPAST_NM_014946_1.67641
CAAACGGGTATATGTGTCTTTACC 391. chr2_MYADML_NR_003143_1.5164
GGAGGTGCACAGCACACCTTCCTCCACTGGGAGAAAGGGGGCCCAATTCC
CACTCCCCCAAACACACACAAGTACACACTGACTAAGGCACAGCTAGGGC
GGGGGCGGGCAGAAGGCCCCTTGGGAGGACGTGGCGCCACAGCTGCAATG
GGTGTGGGGGTGTGGAGCTCATCACCGCTGGAGGTGCTTGGGGGCAGGAG
AAGAAAAGCCTCAGGGCTCCCCAGGAAATAGGAGAAGATGGTCGGGAAAT
AGGCAGATAAGAAAACCAACAGGAAACCTAGAAAAGAATTGAGAGGAAAG
AAACAAAAGAGAGAGTGGAAAAAGAGAAACGGGTGAAAACAGGTTGTGGG
CAACAGAACAAAACAAGAAGGAAACAGCAGAGGAAAGGGAAGAACATACA
TCAGAGAACTGGGAAAGTGCGATGAATT 392. chr2_MYADML_NR_003143_1.52451
ATTAAGTCACACGCCTGGAAAAGGCTGGGAACAGCGAGAGACAATGTCAG
TGTCCACTGGGTCTGGGCTTCTCCCTCCCAGGACCCGCCACCCCGTGGAA
CAGGAACATAGCACCGAGCAGGGA 393. chr2_C2orf56_NM_144736_-1.59119
GTTTTGCGACCACAAGCTTCATGATGTCTTAATTGCCCCAGGAACAGCA 394. chr2_SOS1_NM_005633_-1.53662
AATGGGCATTCTCCAACAGTGGTGGTCCATCTCTGTGCATGGATGGGTGT
GTGTGCTCCCTTTTGTAAGTTTTTGGAGGGAGTTTAGGGATATGTTGAGA
AGTGCTTTGTCGTGGAGGAACAGGCGGCCCAGCAATGGAATGAAGGTCCA
CTTCTTGTGTCAATGG 395. chr2_KCNG3_NM_133329_-1.90165
GCTCGAGTATCTCCGGCGCTGCTAGTAGCGCGCCCTCCGCCCGGCGGTAC
CTGCGGGTGGCCGGGGAGTCCTCGCCGGCGCCAGCGCTGAGCCCCACCGG
CTGGGAACGCGGCTGTGTCCGCGCCGCCGACCCTCGCGCCCGAGGGCTGC
GCACACCGAGGCCGCGGTGCCCTCTCCCAAGCCGCGGGGCCGACCCCCTG
AGGGCTGCGGGCGCCGAATGGAGCCGCCGGGGCGGAATAGCTCCCCGTCT
CCGGCGCTCCCTGCGGCCGCGAATCCGGCGGCCGCCCCGCCGCCGTCCAG
AGGCGAGAGGCAAAGTGAGCGGGTTCGGAGGCGGC 396. chr2_OXER1_NM_148962_-1.74045
TTCAGGTAGCGGTTGAGTGCGATGGCTGTGAGGAAGACAACGCTGGCCGT
GCGGTTGGTGGACAGCAT 397. chr2_ZFP36L2_NM_006887_-1.54393
CGCCCCCGGTGCCGTACAGCAGAGCGG 398. chr2_EPAS1_NM_001430_-1.53409
ATTGGTTACCACCCTGAGGAGCTGCTTGGCCGCTCAGCCTATGAATTCTA

Figure 3-34

CCATGCGCTAGACTCCGAGAACATGACCAAGAGTCA 399. chr2_KCNK12_NM_022055_1.6987
TCGTTGAGGTGCGAACGGCGGCAGCAG 400. chr2_MSH6_NM_000179_1.62899
TGTCGCGACAGAGCACCCTGTACAGCTTCTTCCCCAAGTCTCCGGCGCTG
AGTGATGCCAACAAGGCCTCGGCCAGGGCCTCACGCGAAGGCGGCCGTGC
CGCCGCTGCCCCCGGGGCCTCTCCTTCCCCAGGCGGGGATGCGGCCTGGA
GCGAGGCTGGGCCTGGGCCCAGGCCCTTGGCGCGCTCCGCGTCACCGCCC
AAGGCGAAGAACCTCAACGG 401. chr2_RTN4_NM_207521_1.58875
TCCACGCACCACACCACTGGAGGCGCTCTCCCTTCACTGCGGTTGGGTCA
ATGTGGACGTTTTCCACTCGGCCAGCTCC 402. chr2_SMEK2_NM_001122964_-1.52853
CCACGTAAGTGGAGGAGACGTGCCCGGTGCCTCGGTCGTCCCATTGCCGG
TCTTCGTTCAGGGTATAGACCTTCACTCGCCGCC 403. chr2_KIAA1841_NM_032506_-1.67706
CTGCCCGGCGCCTTTGTCCGCTCTGCGCCCCTGGAGTTTCTGTGCCTCCA
CGGGCGGGAGCGGGGCGCGAAGGTCTGGGGGTGCCCCGAGGACGCGCCGC
GTAGTGAGCCTCC 404. chr2_USP34_NM_014709_3.03899
TTCAGGTCCTTTTGTTCCCATGTA 405. chr2_OTX1_NM_014562_-1.76038
TGATGTCTTACCTCAAACAACCCCCATACGGCATGAACGGGCTGGGCCTG 406. chr2_C2orf86_NM_001042692_-1.60558
GTTCTCTGCCGTCTTCTCTCAGTTC 407. chr2_ARHGAP25_NM_001007231_-1.52759
CTGAACTGTGCTGTTAACAAGATGAGTGTGGACAACCTGGCTACTGTGAT
TGGTGTGAATCTCATCAGGTCGAAGGTCGAAGACCCTGCCGTGATCATGA
GAG 408. chr2_ANTXR1_NM_032208_2.49
AGGGTCAAGAACAACCAGCCAGCC 409. chr2_GMCL1_NM_178439_-1.56413
GCGCGGCGCGACCGGACGCTGCGGGCGGGGAAGAGGATGGAGACTGTGGC
GTCCGCTGCAACGGTTGGGGCTGCGCGT 410. chr2_ADD2_NM_017482_-1.68719
GCAAACACGTTTCCCCGCCAGTCAGGGGCAGCCT 411. chr2_ADD2_NM_001617_2.06957
CCCAGCCGACTCTTCTGCATAGGCCCAAAGGTGCTCCCGGCCCACTGCAC
GGAGCCCACCTCATGGGGCCGGTGCTTCTCCTGCTCCAGGAGGATGAGGT
TCTCCACTCCCCC 412. chr2_CD207_NM_015717_1.57065

Figure 3-35

ATGCACAAGACACAGGAAGATAGGAAATGCAGAAGGAGGAGGAGGTGCCG
GAGAGGTGAGGACAGGGGCTGGATGGACGCTGGGTGGAAGGCAGGGCTC 413. chr2_VAX2_NM_012476_-2.21429
CTCCTCAGCCTCCGAGGCCTTTGCCACCTCCAACATTCTGCGGCTGCTGG
AGCAGGGCCGGCTGCTCTCTGTGCCCAGGGCCCCTAGCCTCCTGGCGCTG
ACCCCTAGCCTGCCAGGC 414. chr2_ANKRD53_NM_001115116_1.58629
CCAGCAAGGAGTCCGACCAGACGGCAATCGACCAGACGGCGATCGGGAGC
TACTACCAGCTGTTCGCAGCGGCTGTGGGCAACGTGGAATGGCTGCGATT
CTGTC 415. chr2_MPHOSPH10_NM_005791_-1.6796
GCAGGTCTGGCGTCGACGGACCCTGGAGCGGTGTCTGACGGAAGTCGGCA
AAGCCACGGGTCGGCCCGAGTGC 416. chr2_RAB11FIP5_NM_015470_1.54358
CTGAGTCGGGTCCTTGGCTTCTCTCAAGCCAAACCAGCTACTCTTGGCCT
TTTCCTCCCCACTGGATGAGTGATGTGGGGAGGCCCCCAGGATGGGACCC
CCCTTTTCCCCCAGAGAGCTTCGGCGACCCAACTCGCT 417. chr2_ALMS1P_NR_003683_1.51336
AAACAGTGGCCGAAGGCTTGTTATGTGCTGTGCCTGGACTTGGCATGAAG
GCACCAGATGTCAGAAGCGAGGCTGCTGCCCA 418. chr2_INO80B_NM_031288_-1.82249
TCTGCTCCAGAAGGCGCGGAGTCAACCTTCCCCTATGCTGCCGCTGCCTG
TAGCTGAGGGCTGCCCACCTCCCGCCCTCACAGAGGAGATGCTGCTGAAG
CGCGAGGAGCGGGCGCGGAAGCGGCGGCTCCAGGCGGCGCGGCGGGCAGA
AGAGCACAAGAACCAGACTATCGAGCGCCTCACCAAGACTGCGG 419. chr2_MOGS_NM_006302_-1.90447
GTGGACTGCTCGTTGTACTAGGAATTCTGGAGGCACCCGGGCTCGGGCCT
CATCCCCCAGTATCTGCTCCCTCCCAATCCAGCCATCAGCATTTAGCAGC
CCCAGCCAGTGGCCAAGGGCTTCCCGGGTGAGGGAGGGATCCCACCGCTG
AACCACCAGCTGGTGAAAGCCTTCATCCCAAAGGAAGCCTCGTGGGAAGA
ATGACCGGGAGGGCACTGCTGTAAAAAGAGGTACGGGTGGAAAGAGGGCT
GGGTCCACCTTCTGCTCAGACCCTTCCACCCCGATGTCTGGCAATACCAG
CCCTTGTCCGTAGAAGTAGCCAATTCCACCAAGGAGGCCGCTGAGGGCAG
CCTGACCCAAAACCTGCTCGCCAGAGCTCAGGCCCCTTCTCCTTCAGCTGG
AAGGTCTTCTCAAAGCGCTCTCTAAAGCCTTCAGCATGGCTCTCCAGGGC
CTGGGTCAGTAGACTGCCTGCCAGTCTTGGCAGGGCTTGATTTCCTCCTG
CCTGGGCACTGCCTGATTCAAACACAAACTCTATGGAAATGGGAATTTTC
AGGGTCACCTGC 420. chr2_AUP1_NM_181575_-1.71301
CCACCCATCCAGCCTGTTGTGAGTTGGGTGAGGGCTGCCCCCAGTCTCCG
TCCTGCGGCTCTGG 421. chr2_LRRTM1_ENST00000433224_-1.98827
CAGAGAGCGGGCTCACTCATGCTTTGCGGGCGGC 422. chr2_FUNDC2P2_NR_003663_-1.70221
CGACAGCGCGCCACTCCGCAGCGTAACCTCGCAGATCCCCTGCGTGTG

Figure 3-36

423. chr2_TMSB10_NM_021103_1.52673
AGAGCCACCTGCAAGATGGACACGAGCCACAAGCT 424. chr2_KCMF1_NM_020122_1.52353
TTTATACTATGGTGGGGAAGCTTTCTCTGTAGAGCAGCCACAGTCTTTTA
CTTGTCCCTATTGTGGAAAAATGGGCTATACGGAGACATCTCTTCAAGAA
CATG 425. chr2_TGOLN2_NM_006464_1.617
GGATAGCGCTTCCGCCCTCTAATGCTCTCGCGAGATCCGCGCGCGGGGCC
CCTCTCCAGTCCCGCCCCTGCTGCGCGCGTCTCTCAGTCTCCCGCTGCCG
CCAAGACGAAGGGCGGGATTTAGGGGGCAGCTGCTGATGTCGGCGCTCGC
CTTCGGCT 426. chr2_SH2D6_NM_198482_1.592
AGCCTTGGTACTCGGGGAACTGTGACCGCTATGCTGTTGAGAGTGCCCTG
CTCCACTTACAAAAG 427. chr2_USP39_NM_006590_1.91377
TGTCCGGCCGGTCTAAGCGGGAGTCTCGCGGTTCCACTCGCGGGAAGCGA
GAGTCTGAGTCGCGGGGCAGCTCCGGTCGCGTCAAGCGGGAGC 428. chr2_SMYD1_NM_198274_1.60075
TGCGGGCAGGGCTGACCAACTGGCATGCTGGTAACATTGAG 429. chr2_---_---_1.6146
TAATTGTAATCTTGTAGACAGTAA 430. chr2_---_---_1.6036
GCATATCTTTACTCTGACACTGTCA 431. chr2_ARID5A_NM_212481_-1.5755
GTCCTTTGTGGGTGCCAGCGGCTGTCCT 432. chr2_ANKRD23_NM_144994_-1.66486
GGGTGCGGGGATGCGCCACGTGGGCCTGCAGGGCCTCCCGGATGCCGCGC
TGCCAGTCTCGAGCCAGCTGCACCGGG 433. chr2_FAM178B_NM_001122646_-1.60765
ATGTCCTGGCAGCTAACAACTACCCCGGCCAGCAT 434. chr2_ACTR1B_NM_005735_1.60033
GAGAGCACGATGTTGGCGAACAGCGTCCGGCGCAGGTCCATGTCGGACTT
GTGTATGGCGAAGGCCACCACCTCATGGAGCCCCTCACTCTCATCCCCGA
CAAGGTCCGGCTGGAACAGCAGC 435. chr2_AFF3_NM_002285_1.85297
TATTGTGTCCAGAGGATACAAGCT 436. chr2_LONRF2_NM_198461_-1.99517
CAGAGGGCACACTCAAAGTCAGTTAC 437. chr2_CHST10_NM_004854_-1.61588
TCGAAACGGGCATACAGGCGTCGGATGTCTCGTTTGCTGATGCCCAGGAA

Figure 3-37

ATAGTGCTCCACCTTGGTTCTGTTATACACGGTAATGCCCGGAGGGATAG
TCGGGTATGACACCAGGTGGTCAATGCCAGCCTCTTTTAAGATGTATGGG
GCATCGTCCTCCAGGGTCTCGTGGTGTCCAATCA 438. chr2_NPAS2_NM_002518_1.87962
ATCGTCCTGCGACCTCACACAGCAGCTCCTGCCTCAGACCGTTCTGCAGA
GCACGCCCGCTCCCA 439. chr2_TBC1D8_NM_001102426_-1.6895
TCGGCTCCTGCAGATCGGGGTCGAGGTCAAAGACCTCATTATCCAGCAGC
CTTCGCAGCGTCACGTCGGCCAGCTG 440. chr2_RNF149_NM_173647_-1.96842
TAGGAGATGGGTCCTCCATGCCGAGAGTCACTCCTGCCGGCTT 441. chr2_IL18RAP_NM_003853_1.71848
GTAGCCTGTTGTGTCAAGATGATTTTAGAAGTTAAGCCCCAGACAAATGC
ATCCTGTGAGTATTCCGCATCACATAAGCAAGACCTACTTCTTGGGAGCA
CTGGCTCTATTTCTTGCCCCAGTCTCAGCTGCCAAAGTGATGCACAAAGT
CCAGCGGTAACC 442. chr2_SLC9A2_NM_003048_-1.65419
TCTGGAGGGCATCGGAACCTGGAAGCCGGAAAGCCCGATTTGGGAGTGAG
AAGC 443. chr2_MRPS9_NM_182640_1.5573
GACTACTTACTACTGATCCACGTGTGAGGGAACGGAAGAAGCCAGGCCAA
GAGGGAGCCCGCAGAAAGTTTACGTGGA 444. chr2_UXS1_ENST00000409032_-1.55502
TCAAAGCTCAATCCAGACGTCAGTCTGTATGGGAAACCTTCTCACCATCC
TTGGTCAGAAATAATCCCTTGCCTGCACCACTAGTCCACAACAGCTCAGC
GCTGCCTTGTCCAGAGATTCACACATGC 445. chr2_FBLN7_NM_153214_1.57907
GAGGGCAGCGTGGCCGGCGACTCCGCCTTCAGCCGCGCGCCGCGCTGTGC
GCAGGTGGAGCGGGCTCAGCACTGCAGCTGCGAGGCCGGATTCCACCTGA
GCGGCGCCGCCGGCGACAGCGT 446. chr2_FBLN7_NM_153214_-1.79473
ATCACGCTCTTCCGCATGGCCACAGCCTCTGCCCCCGGCCGAGCTGGGCC
CAACAGCCTGCGGTTTGGGATCGTGGGTGGGAACAGCCGCGGCCACTTTG
TGATGCAGCGTTCAGACCGGCAGACTGGGGATCTGATC 447. chr2_IL1F7_NM_014439_-1.9666
CTCCCCACCATGAATTTTGTTCACA 448. chr2_IL1F10_NM_032556_-2.41794
TCCCTCCCCATGGCAAGATACTACAT 449. chr2_SLC35F5_NM_025181_1.5382
GACTCTCACACTGTTCGCTGTCTTC 450. chr2_SCTR_NM_002980_-1.65381
ATTTCTGCTGGTGAGCATCCGGAGGAATCTCGGGCATTCCACCTCCACCA

Figure 3-38

TCCGGCCCGGCACAGAAGAGGGC 451. chr2_TMEM177_NM_001105198_1.57991
GGACACTTCCAGCTTGTGCAGACACCACCCTGCCATTGAGTCTGGAGGGC
CCTGTTGGAGCCTTTGGACCTATAGCTCACGGCCAGAAAAATCACTGGCT
TTGGAATTAAATAGCTTAGATTGTACTATAACCACTACTTATGAACTCAG
GGACTATGAGGGACTATTCAGGGGCTATGAATCTGAGCCTTTGTTTCTTG
AACTGTAAAGTGGAGATGATGTAAACCGCCTTGCA 452. chr2_EPB41L5_NM_020909_1.77174
CTCTGCCTGTGAGTCCTTCCATTTCCTC 453. chr2_LOC84931_NR_027181_1.51039
CAGCTAAGGAAAGACCGGAATCGTCCGAGCCCTTTG 454. chr2_TFCP2L1_NM_014553_1.63259
AATGTCTCTGAGAAAGGCCGTGCACATACATTGTGGCATCTACCATGCCA
ATGCGCCAGTGCAGAGACAGGA 455. chr2_CYP27C1_NM_001001665_1.58405
AAATGCACAGGATACTGCCAGTCATTAAATATTGAGTCTAGCACAATGTA
TGAAGCATAAAAATTCACTGCCACTGGTTTTTAAACAGCTGTTTCCCCCA
AAGAAAGGGCAACTTCTGGTATGCACCAGTAAAATAGCAACCTTTTTACA
TTACTTTGCATAAAGATTTACAAGTGTCCCAGGACCTGGGAGGCCAGTCT
ATAACAAGACAGCCTTTAGCGACATCGCTTTCCTTCTCCACGGTGATCAG
CGAACACAAATACCCACTGTGTGTCGGCGAGCTGGTCTGCTACATCAG 456. chr2_AMMECR1L_NM_031445_-1.56105
AGTAATAGAAGTAACTGGACCAGGAAGAGGAGGCATCTGCTCCAATGATG
TCATAGCCATTGGTGGCCACGGGGGGGTGGGACTGGTCATGCAGCCGTGT
G 457. chr2_LOC401010_NR_002826_1.5068
CTCTTAAGCAGCATACGGCACTGCTT 458. chr2_MGAT5_NM_002410_-1.59222
AGAATTCCGGTGGATGAGACTACGGATCCGGCGAATGGCTGACGCATGGA
TCCAAGCAATCAAGTCCCTGGCAGAA 459. chr2_TMEM163_NM_030923_1.88745
CGTCGCTGAACTGGCCGCTCTCGCT 460. chr2_ZRANB3_ENST00000412849_1.51692
TTTGGGGTCGTGGCTGCCTATCTGGAGTGCT 461. chr2_---_---_-1.53311
CAGTCAGGAAACGAAGCAAGGCTTGGGCTGAGTGAATTTTCTATTCTACA
GGGTATCCAAAGAGGTCCTTTGTTGGCATTTAACAGGCCGGTGGACTTGG
TCTGGAGCATCCCGGATTGCTTCTCGCACCTGTCTGG 462. chr2_LCT_NM_002299_1.53419
GTGCCCATGACAGAAATACCTTATAATGGGTGATCTGACTGGCATGGA 463. chr2_LRP1B_NM_018557_1.53043
CTGTCTCCGGTGTATTCCGGCTGGCAGTGGCAGTAAGGCTGGTTTCCAGC

Figure 3-39

AGTCACAATGCAGGTTCCTCCATTTTGACAAAAATCCTCACAGACTGTCT
TACCACAGTTTGGCCCAGT 464. chr2_LRP1B_NM_018557_1.65117
GTGGTCGCCCGGTAAGGAAGCCTGCGCTGGAGACTGCTC 465. chr2_LRP1B_NM_018557_-1.83068
TTGGAGCCTGGAATCGAGCGGCGTCATTTACAAATGT 466. chr2_ZEB2_NM_014795_-1.65297
GAGTCAGAGTACCCCTGAGGGGTAATGCTCTGCAAGTAAGCCCGGTTCAT
CAGCAGCTCGGTGGGTTCCAAGTGCCCTTTCTCGCGCGCCTCGCGCTCCG
CCGCTTCCCGCTCCTCCGCCTCCCGCTTGCAGTAGGAATACCTGTGATTC
ATGTGCTGCGAGTACGAGCCCGAGTGTGAGAAGCGCTTGCCACATTTATC
ACACTGATAGGGCTTCTCGCCCGAGTGAAGCCTTGAGTGCTCGATAAGGT
GGTGCTT 467. chr2_ZEB2_NM_014795_-1.67899
CTGGCGTGCCAAGGCGAGACAGCTCCTCAGGGGCTTCTGGGTAAATAATG
GCTGTGTCACTGCGCTGAAGGTACTCCTCGATGCTGACTGCATGACCATC
GCGTTCCTCCAGTTTTCT 468. chr2_KIF5C_NM_004522_-1.58491
CCCGGTTTGAACATCGTTCTTTCAGAAGTGCTGAAAATGCTGCAAAGTTG
GATAAGTGGAAATGTGGCTGCCCCTCTCCTCACTACTTCCTCTCTGATCG
TTCTGAAGCTTGCATTGGGAATGGCTGCTTTCTCTAACCATTTTCAGCTT
GAGTGGGTATTGCTGAAGAAATCCAACATCATTCCAGCAGTTGAAAAAGG
AAGCCTTCGGGAGAAAGTGCTTGTCAAAATTTTGTTCTTTGTGCTTGTGT
ATGAGTAAGTTGCCATGAATAAGTTATTATTTTAACCCATAATTGGCGAC
TGTTTATATGAATTCTTTCTTTGGCACCAAATAGGTTTCATCTTCTTAGG
CACAATTAGAAAAAAATCCACATAGATGGATATTTTTACATTTAGTTATTGC
TTTATCCAAATACATGAATCTAAAGCTGAATCAACCCTTACTTCCAGTTG
TGCTTATTAAGAAGATCAATTTCCAAGTAGTAAAGTTTTCAGGGAAACTG
ACTGTGCTGCTATTTGTTTTGACAAATTTGGGGGTAAGTCAATGACAACC
AAACCAATCTCGGTGGAAACTCCTATCCTATCATGTTGTGTGCCCAAGAT
GAGTGAGCTGGCACTGTGCCCTGAAGCTTTCACCACTGTAATGAAATATA
TGCCAGGGGAGACTTTGGGCTTTTCTCATGACTGTGTGGGTCGAAGGTAG
CTCAAGTGTGTGTGTGTGTGTGTGTGTGTGTGTGTGTGTGTGTGTGTGTG
TATGTGTGTAAAGTGCTAAGAACTGTGCATTGACATCCAAACATTTCTTG
TACAAAATTTCCCTAGCAAAGCAAACCTGCTTTGACTTAATTTATTTGTT
AAATGTTGCACTTTGTTTATGTATGTTTTGTTTTTGGTGGGGAATAAGGA
GAGAGAGGACGACAAATTCTATTGAAGTATTTATTTTGTGAAGATGGCAA
TTTTGCATTTGTTTAAATTTTTTTCATTCTTTAATTTTGTTATCAGTGCC
AGCCCAATATACCTGCTCTACCATTATTTGCGGTCTGATAAAAGGGTCCT
TG 469. chr2_NEB_NM_001164507_1.51098
GGCTGCCTTGATAGGAATGGCATCTACCCGCATGTCATAACCTTTCCTCT
TGGCTTCTTCTAGGCCAAGCTTATA 470. chr2_CACNB4_NM_001005747_1.6418
CGTAACCTTTCAGTGACGGCCCCACTAACACCACCGGACGCATTGACGGT
ACAACATCGTAAGGAGGAATGTGCTCCG 471. chr2_TBR1_NM_006593_-1.52652

Figure 3-40

GGGTCTATATGCATCCGGATTCCCCCAACACTGGGGCTCACTGGATGCGC
CAAGAAATCTCTTTTGGAAAATTAAAACTTACGAACAACAAAGGAGCTTC
AAATAACAATGGGCA 472. chr2_TBR1_NM_006593_-1.5473
TGCCGCACACCAACGGGCTGCTGTCGCCGC 473. chr2_GRB14_NM_004490_1.6184
TGGGCGGCCAGCGGCGAATCCCGGGCAGCC 474. chr2_ABCB11_NM_003742_1.55701
AGTGGTGACTAGTTTGTAGTAGGCTCCTTTTTGGGCCATCAGTTCTTCAT
GGGTCCCCTTTTCAATCA 475. chr2_LRP2_NM_004525_-1.53571
CATCAGAGGCATCAAAACAATCTGTTTCTTGATCACAATACCAATGTTGA
GGAATACAGCGCCCAGATGCGCATTGGAACTCACTGCT 476. chr2_METTL8_ENST00000375258_-1.84193
AGAACCTCCCAGGGCGAAGGTCGGGGCCGAGAAGCTTGTGAGTACCGGGG
CAGTGAGGGAGGGATCCCTAAGTGCAGGGCGCACACACGGGGCGGAGACC
TGGAGGCGGCAGCACCGCGCCCCCAGGGCTCTGCCCAGCTAGCCACTCGC
AGCACAGAGA 477. chr2_SLC25A12_NM_003705_-1.5299
CTGTAGAGTCCAAAGAAGCCCTCATAACGCAAGACTTTCTTAAAACAGTC
AAAGCTGTTTTTGTACATTAGCTCCCCAACAACAGAGCCAGAGCCACGCT
GGTTTTGCATTCGGGTCTTCACCAGATCTATAGGAT 478. chr2_DLX2_NM_004405_-1.62083
GACCGGGAGGTCAATAACTGCAGCGTCCGAGCTGAGCCCAGGGGAGCGGG
CGAGGAGAAAGAAGCCTCAGAGCGCCCGGGAAGCCTCGCGCGCCTGGGAG
GCTTCCATCTCCCGGGACC 479. chr2_ITGAV_NM_002210_-1.53465
TCTTCTCGTGGGAGCTCCCAAAGCAAACACCACCCAGCCTGGGATTGTGG
AAGGAGGGCAGGTCCTCAAATGTGACTGGTCTTCTACCCGCCGGTGCCAG
CCAATTGAATTT 480. chr2_COL3A1_NM_000090_-2.01573
CTACTCGCCCTCCTAATGGTCAAGGACCTCAAGGCC 481. chr2_COL3A1_NM_000090_1.84352
AAAGGTCCAGCTGGGATACCTGGAT 482. chr2_COL3A1_NM_000090_2.43773
CTTCCCTGGTGCTCGTGGTCTTCC 483. chr2_COL5A2_NM_000393_1.81995
GCTGTCCTTGTAAACCCTGTGGTCC 484. chr2_NAB1_NM_005966_1.58143
GGAGGAACATTTAAGCTGATGGAAGTGGAAGTGGAAGTTGCTGTACATTG
GCAGCAAGGCCTCCGAGTTAGCTTTTGAATGCAGTTAACTGGTTTCTCTT

Figure 3-41

AACTGTGGAATTCATTGAAAAGTCAGACTCCGAGTGGTCGTTCCAGGATA
TCTT 485. chr2_STAT1_NM_007315_1.55122
TCATTCGTTCTGGTGCCAGCATTTT 486. chr2_MARS2_NM_138395_1.5302
TTTTCTACGTGAACGCGGCGCCGCACATCGGGCACCTGTACTCGGCACTA
CTGGCGGACGCCCTATGCCGCCACCGTCGCCTCCGAGGTCCCAGCACGGC
CGCCACGCGATTCTCCACTGGTACCGACGAGCACGGGCTGAAGATTCAGC
AGGCAGCAGCTACCGCGGGCCTGGCCCCGACCGAGCTGTGCGACCGAGTC
TCTGAGCAGTTCCAGCAGCTTTTCCAGGAGGCCGGTATCTCCTGCACAGA
TTTCATCCGCACCACGGAGGCCCGGCACCGGGTGGCTGTGCAGCACTTCT
GGGGGGTGCTTAAGTCCCGCGGTCTGCTCTACAAGGGCGTCTATGAAGGT
TGGTATTGCGCTTCCGACGAGTGCTTCCTGCCTGAGGCCAAGGTCACCCA
GCAGCCGGGCCCATCGGGGGATTCGTTTCCTGTATCTCTCGAGAGCGGGC
ATCCAGTCTCCTGGACCAAGGAAGAAAACTACATTTTCAGGCTTTCCCAG
TTCCGGAAGCCACTCCAGCGGTGGCTGCGGGGCAACCCTCAGGCGATCAC
CCCCGAACCATTTCATCACGTAGTTCTTCAGTGGCTGGACGAGGAGCTGC
CCGACCTGTCCGTGTCTCGCAGAAGTAGCCACTTGCACTGGGGCATTCCG
GTGCCCGGGGATGATTCGCAGACCATCTATGTATGGCTGGATGCCCTGGT
CAACTACCTCACTGTAATTGGCTACCCAAATGCTGAGTTCAAATCTTGGT
GGCCGGCCACCTCTCATATCATAG 487. chr2_ALS2CR11_NM_001168221_-1.65998
CTGGAGGTGGTGCAAGATTCATAAACAT 488. chr2_ALS2_NM_020919_1.57709
AACTGCTCCTCAGGTGTAGTTATCT 489. chr2_BMPR2_NM_001204_1.61342
CCTAGTGAAAAATGATGGAACCTGTGTTATTAGTGACTTTGGACTGTCCA
TGAGGCTGACTGGAAATAGACTGGTGCGCCCAGGGGAGGAAGATAATGCA
GCCATA 490. chr2_PARD3B_NM_205863_2.30173
ACCTGTTCGGCCCGGCCCGGCGTG 491. chr2_PARD3B_NM_205863_1.61202
GATGTCACCGGACGAACCCAGGAAGAGCTTGTGGCCATGCTCAGGAGCAC
CAAGCAGGGGGAGACAGCATCGCTGGTCATTGCCCGCCAAGAAG 492. chr2_INO80D_NM_017759_-1.53597
CACTGTAGGGAGACGGCACATGCTCACTATCATAATGGCTTCCATGGGGT
GAGGAGTGTGAGTGATCACTGCTGTATTGCTGTCGTGAGGTGATTAGGTC
ATCTGCCTTGCTCAGCAGCTGGGCAGGATGTGGCCTCTGGGAGGCATGGC
TGCCGTCATGAAGTCCATGAAACTGTCCTGGGAAGGCTCTCTCCCCAAGT
GCACTCTGGCTGATCAGAGTGGCAGAAGTAAGGCCAACGTTGGCTGGGGC
AGAGAACTGCCCCTGGATCTGCCCTGCCAGGGGTGTAGGTGGGTTTGACA
AGGTAGCAGAACGGAGCAGGTTCTCATCCAGCTCTAGACTAGAAAAATTA
TCATGTACTATACGCCCATTCAATAGCTCCCCTAGGTCTGTGTTCACCTC
TCGGCTCAAGGATTGTATTCCTGAAGCTCCAGTACCTGTGGAGAACACCC
CTATTCCTCTATCTGACAACTCCTGGACTGGCACACCATCTGACTGGGCA
AGGACCCCAATGGTACTCAGGCACTCGAGAGAAGTTACAGCCTGCA

Figure 3-42

493. chr2_KLF7_NM_003709_2.07352
AGGCAGACATCCAGTGGCCCTTTTGTT 494. chr2_FZD5_NM_003468_1.59884
TGAGCATGAGCACCCAGTACTCGGGCTTGGCGCGCGGCTGGCCGGTGTCG
TGGCCCGGGCAGGCGCAGGTGAGCGCCGCCTCCCAGCTCTCGCGGTAGTG
CTGCTCGTACAGGTAGCAGGCCACCACAATGCTGGCGGGGACCGTGTAGA
GCAGCGTGAAGATGCCGATGCGGATCATGAGCTTCTCCAGCTTGTCCGTC
TTGGTGCCGCCCTGCTTGATGACGCTGCGGATGCGGAAGAGCGACACGAA
GCCCGCCAGCAGGAAGAGCGTGCCCACCAGCAGGTAGAGCACCAGCGGGC
CCAGCACGAAGCCGCGCAGCGAGTTCAGGTTCTGGTTGCCCACGTAGCAG
ATGCCGGCCACTGGGTCCCCGTCCACGGAGCTCAGCGCCAGTGCCGTGAT
GGACTTGACGCTGGGGATGAGCCACGCAGCCAGGTGGAAGTACTGCGCGT
AGCCCGCGATGGCCTCGTTGCCCCACTTCATGCCGGCGGCCAGGAACCAG
GTGAGCGACAGGATGACCCACCAGATGGAGCTGGCCATGCCGAAGAAGTA
GACCAGGAGGAAGACGATGGTGCACAGTGCAGGGCCCGTGGTCTCGTAGT
GGATGTGGTTGTGCTCGCGGCTGCAGGCCACGCTGGCATGGCCCACGACC
AGACGCACCAGGAAGCCCAGCGACACGCACAGGTAGCAGGCTGACAGGAA
GATGATGGGGCGCTCAGGATAGCGGAAGCGTTCCATGTCGATGAGGAAGG
TGGCCACTGTGGTGGACGTGGAGATGAAGCACAGCACCGACCACAGGCCT
ATCCAGAAGGTGGCGAACGTGCGCTCGTCGGCACTGAAGGACGGCTGGTA
GCAGGGTACCGCGCAGTTGGGCACCTGGCCCGTCCGCACCTTGTTGTAGA
GCGGGTGTGACTCCTTCAGAATGGGCACGAAGGGCTCGCGACACTTGCAC
ACGAACGGGCCCCCAGCGGGGCATTCGCCCCCCGAGGCCGGCGCCCCTGG
CGGGCCTGGAAGGGTGGGCTTGGCTGGGAAAGGCCTGGGGGGCGCCGTGG
TGGCCTCGCTGCGGTTGTAATCCATGCAGAGGACCTCGGCGTCGCGGCCC
AGCACCGGGAGGCGGTCGCAGCTCATGCGCTCGGGCCAGGCGAAGCCGTA
CTGGCGCATCAGCGGCGAGCAGCCGGCCTTGGCGCGCTCGCACACCGAGC
GGCAGGGCGGCAGCGGCTTGTGGTAGTCGGGCAGACAGATGGGCGTGTAC
ATAGAGCATAGGAAGAAGCGCAGGTCCGGCGAGCATTGGATCTCC 495. chr2_FZD5_NM_003468_1.63305
CCACGGATCCCGCCGAGAAGAGCAGACAG 496. chr2_MAP2_NM_002374_-1.62057
AAACAGAAGTTCAGGCCCACTCTCCCTCCAGGAAATTCATTTAAAACCT
GCTATCAAATATACTAGACCAACTCATCTCTCCTGTGTTAAGCGGAAAAC
CACA 497. chr2_SPAG16_NM_024532_1.67506
AGACATCCTAGTCTCCTGTGGCGAGGACCGACTCTGGAAGGTGTTGGGCC
TTCCAAAATGCAATGTGCTTCTCACGGGATTTG 498. chr2_FN1_NM_212482_1.72009
AGTGGAGGCGTCGATGACCACAGGGGAGCTCCGAGCATTGTCATTCAAGG
TGTACAGGTAGATCTTGTAGTCAGTGCCTGGTTGTAA 499. chr2_TMEM169_NM_001142310_-1.55341
GCCGCTACGTCACCTTAACTGGGACCATCACACGAGGGAAGAAAAAGGGT
CAGATGGTGGACATCCATGTCACATTGACAGAGAAAGAGCTGCAGGAACT
GACCAAACCTAAAGAGTCATCAAGGGAAACGACGCCTGAAGGAAGAATGG
CCTGCCAGATGGGAGCTGACCGTGGGCCCCATGTGGTCCTCTGGACGCTG
ATCTGCCTGCCTGTGGTTTTCATCCTTTCTTTTGTTGTCTCTTTCTACTA
CGGCACTATCACCTGGTACAACATCTTCCTCGTGTATAATGAGGAAAGGA
CCTTCTGGCACAAGATCTCGTATTGCCCTTGCCTCG

Figure 3-43

500. chr2_SMARCAL1_NM_014140_-1.50733
AGGACCTGTGCCAGCAGTTCCAACTGTCGGAGAGGCATGCTGTGGCCGTG
CTGTCCATCACCGCTGCCAATATGGGCCTCACCTT 501. chr2_RUFY4_NM_198483_-1.82726
TCAGACTTGGGCTCCGGAAGGCTGAG 502. chr2_ARPC2_NM_152862_-1.56657
GGCGGCTCGGCAGGCGGGTTCAGGCTTCGGGG 503. chr2_GPBAR1_NM_001077191_-1.62597
TCGAAGTCTATGGGCTCCTGCTGCCCGCCGTGGGTGCTGCTGCCTTCCTC
TCTGTCCGCGTGCTGGCCACTGCCCACCGCCAGCTGCAGGACATCTGCCG
GCTGGAGCGGGCAGTGTGCCGCGATGAGCCCTCCGCCCTGGCCCGGGCCC
TTACCTGGAGGCAGGCAAGGGCACAGGCTGGAGCCATGCTGCTCTTCGGG
CTGTGCTGGGGGCCCTACGTGGCCACACTGCTCCTCTCAGTCCTGGCCTA
TGAGCAGCGCCCGCCACTGGGGCCTGGGACACTGTTGTCCCTCCTCTCCC
TAGGAAGTGCCAGTGCAGCGGCAGTGCCCGTAGCCATGGGGCTGGGCGAT
CAGCGCTACACAGCC 504. chr2_GPBAR1_NM_001077191_-2.19928
TGACTCCTACCAGAGCATCCGTCCAGCTCAGCCATCCAGCCTGTCTCTAC
CGGGCCCCACTTCTCTGGATCAGAGACCCTGCCTCTGTTTGACCCCGCAC
TGACTGAATAAAGCTC 505. chr2_STK36_NM_015690_-1.80946
TTGGCAAATCAGCTAACTGAAGACAGCAGCCAGCTCAGGCCATCCCTCAT
CTCTGGCCTGCAGCATCCCATCCTGTGCCTGCACCTTCTCAAG 506. chr2_STK36_NM_015690_1.53168
GCAGCAGCCTGTCTATTGGGACAGCTTGGTCAGCAAGGGGTGACC 507. chr2_STK36_NM_015690_1.57742
CCATCGTCTCGTTTCTCTCAGTTGCCCTCCTGAGTGACCAGCCACTGTTG
ACCTCCGACCTTCTCTCTCTGCTGGCCCATACTGCCAGGGTCCTGTCTCC
CAGCCACTTGTCCTTTATCCAAGAGCTTCTGGCTGGCTCTGATGAATCCT
ATCGGCCCCTGCGCAGCCTCCTGGGCCACCCAGAGAATTCTGTGCGGGCA
CACACTTATAGGCTCCTGGGACACTTGCTCCAACACAGCATGGCCCTGCG
TGGGGCACTGCAGAGCCAGTCTGGACTGCTCAGCCTTCTGCTGCTTGGGC
TTGGAGACAAGGATCCTGTTGTGCGGTGCAGTGCCAGCTTTGCTGTGGGC
AATGCAGCCTACCAGGCTGGTCCTCTGGGACCTGCCCTGGCAGCTGCAGT
GCCCAGTATGACCCAGCTGCTTGGAGATCCTCAGGCTGGTATCCGGCGCA
ATGTTGCATCAGCTCTGGGCAACTTGGGACCTGAAGGTTTGGGAGAGGAG
CTGTTACAGTGCGAAGTACCCCAGCGGCTCCTAGAAATGGCATG 508. chr2_PRKAG3_NM_017431_2.68922
CTGCGCAGTGCGTGCTCCAGCCCG 509. chr2_WNT10A_NM_025216_1.52694
CAGCCGCTTCCACCGCGCCACGCTCATCCGGCCGCACAACCGCAACGGCG
GCCAGCTGGAGCCGGGCCCAGCGGGGGCACCCTCGCCGGCTCCGGGCGCT
CCCGGGCCGCGCCGACGGGCCAGCCCCGCCGACCTGGTCTACTTCGAAAA
G

Figure 3-44

510. chr2_FEV_NM_017521_-1.61447
CCCCCTGCTAAGTGCGGCAGGTGGAGTAAACTCTGGATTAGAGGACGGTT
GACGGAGGCTCCCGGGCCCTCCCCGGGATGCCGATGGGATCG 511. chr2_CRYBA2_NM_057093_-1.93468
TGGGTAGCGGATGAAGAACCCGGGGGCTGGACCCGGCCTAGCTCTGGACC
CGGCTGCCAGGGGCTCGCAGTCTTCCCGCGCTCCC 512. chr2_CCDC108_NM_194302_-1.50179
GCCAGGCGTGACCCCTAGCGGCATGTCGGAGAGGCT 513. chr2_ABCB6_NM_005689_-1.52597
TAGAATATAGGCACCAACACATTGAGTGCCCGTTCCAAACCCATGAGCCC
CAGGCAGATGAGCACCACCAGCTGCAGAGCTGGACTCCCTCGAGGCCACA
GGTAGCCACTCAGGAGG 514. chr2_DNAJB2_NM_006736_-1.52381
GCGGGAGGCACAGCACCGACGGCAGGGGCGGCCCAAGGCCCAGCACCAAG
ATCCAGGCTTGGGGGGGACCCAGGAGGGTGCGAGGGGTGAAGCAACCAAA
CGCAGTCCATCCCCAGAGGAG 515. chr2_PTPRN_NM_002846_-1.58955
TTTCCGAGCTCCGGGCGCTCGCTCCCGGGCCGGAGCCGCAGCGACGCTGG
CGGGAGCCTGC 516. chr2_DES_NM_001927_2.04907
TGTCAGACCTGACCCAGGCAGCCAACAAGAACAACGACGCCCTGCGCCAG
GCCAAGCAGGAGATGATGGAATACCGACACCAGATCCAGTCCTACACCTG
CGAGATTGACGCCCTGAAG 517. chr2_SPEG_NM_005876_-1.74118
AGTCCCAGCCAGAACCGCCGTTCTTCTGACACTGG 518. chr2_CHPF_NM_024536_1.87563
CTACGGCCAGCCCTGCCCAGCGAG 519. chr2_STK11IP_NM_052902_-2.34265
GGAACTCTGTCGCCCCTTGTTGGTGT 520. chr2_PAX3_NM_000438_-1.60935
CGGCCCTACAATTGCTCAGAGATGCCCAGTCTCATACATTTAATGGCAAC
AGAGTGAGAGCTTCCCCTGCCCCCTACAACAGAGCACAATTCACAGTTCT
AGAATCCCAGGGGCTGAAAGTGGTTAAGAAAGAAAGATTTACAAAACAGA
AAAACTAAGCAGAATAGAAATGTTTGTTTTGATTCCTAGTGTCCCTCTGG
TCTTTCAGTTCCATGTCGTTACTCAGGCGCAGAGACACCGCGCATGAAGG
GACCTTGAT 521. chr2_COL4A4_NM_000092_-2.72976
CTGGTGGACCAGGAAATCCCAGTC 522. chr2_COL4A3_NM_000091_1.50266
AAAAGGTCCACCTGGAACTGCAGGA 523. chr2_COL4A3_NM_000091_1.56054
AGCTGCCTGCAGCGATTTACCACAATGCCATTCTTATTCTGCAATGTCAA

Figure 3-45

TGATGTATGTAATTTTGCATCTCGAAATGATTATTCATACTGGCTGTCAA
CACCAGCTCTGATGCCAATGAACATGGCTCCCATTACTGGCAGAGCCCTT
GAGCCTTATATAA 524. chr2_SLC19A3_NM_025243_1.50783
GTTGCAATAGCTTCTACGGCCCCATTATAGATGGAAGAATCTTGGGATGG
CGCCTTGTAATCCCACAGGATTTGAACATAGTTCAAAACCTGGTTAAAAC
CTGCTGTGGCGAAAGCCCACCATAGAGACCAGTAG 525. chr2_PID1_NM_017933_-1.51033
TTTTGGCAGAGGAGACGCTGGCGAGACTGTCGATCGCGCCGGGGGGCGAG
GGGCTGGGGTCCCGCTTTACATCTGGGGTCGGTGTCCGCGGGATGTGCGT
CCTGG 526. chr2_DNER_NM_139072_1.67871
GGTGACAAGGGTTGCTGGCACAAGGATCT 527. chr2_TRIP12_NM_004238_-1.50011
GTGCCATAACTCATCATGCTTTTTTGCATTTCTAGGGGAAGTTTTCGTTG
GAGCTGTTTGGGCTCTTCCTCTTTTACCA 528. chr2_SP140_NM_007237_-1.51187
TAATAGCAAAGCCGACGGCCAGGTGGTCTCCAGTGAAAAGAAGGCGAACG
TGAATCTGAAAGACCTT 529. chr2_SP140L_NM_138402_1.77768
CCTTTACTTCCAGTGACCTGTGGT 530. chr2_ARMC9_NM_025139_1.80393
TCCACCATGTTACGAGCCTCCTTGGCACC 531. chr2_NGEF_NM_019850_1.7183
CCAGCTCCTTGTGAGCATCCAAAGCAGTGCACTCCCGCTCAGACCTCTCT
TCTAC 532. chr2_SAG_NM_000541_-1.83634
GAAGTCGCCACTGAGGTCCCATTCCGCCTCATGCACCCTCAGCCT 533. chr2_DGKD_NM_003648_-1.63673
ATGGCATACGAGGCCAAGCTCCCCCGGCAGGCCTCCTCCTCTACCGTCAC
CGAAGACTTCAGCGAG 534. chr2_DGKD_NM_003648_1.51529
ATCCGAGAAATAGCTCAGTCTCACCGGGACATGGAGCAGGAACTGGCCCA
CGCCGTCAATGC 535. chr2_ARL4C_NM_005737_1.97128
GGGCGGACAGCAGGACCGGCTCTTC 536. chr2_COL6A3_NM_004369_1.77433
AATGCCTTGTTCTCCTATCAGCCCTGGAGGACC 537. chr2_RAMP1_NM_005855_-1.53731
TGCATGGCCGCTACTTCAGGAGCTGCCCCATCTCAGGCAGGGCCGTGCGG
GACCCGCCCGGCAGCATCCTCTACCCCTTCATCGTGGTCCCCATCACGGT

Figure 3-46

GACCCTGCTGGTGACGGCACTGGTGGTCTGGCAGAGCAAGCGCACTGA 538. chr2_PER2_NM_022817_1.57273
GGAACACGCCCACATCGTGAGGCGCCAGGAACTCCACAAACTTGGCATCG
CTGAAGGCATCTCTTTTACAGTGAAATATGGATGCAACCTGGTCAGAGAT
GTACAGGATCTTCCCAGACACCAGG 539. chr2_TRAF3IP1_AF242456_-1.5399
TTGCTAAGGCCGCGCAGCCCTAGTGACCGAACGCCCTGCGGCGGCCGCGC
AGGCGCTGTGGTGGGCTCCGGTGCACTGTGGGATGGAAACCGGAGCGGCG
CGTCCT 540. chr2_TRAF3IP1_NM_015650_-1.5616
TTGAAAGAAGACCGCAAGCCAAGAGAAAAGGACAAGGACAAGGAGAAGGC
CAAGGAGAATGGCGGAAACAGACACAGAGAAGGGGAGAGAGAGAGAGCCA
AAGCCCGGGCCAGGCCAGACAACGAGCGACAGAAAGACAGAGGCAACAGG
GAGCGGGACAGAGACTCCGAGCGCAAGAAGGAGACAGAGAGAGAAAGAGTGA
GGGGGGGAAAGAGAAGGAGAGACTGAGAGACAGGGACCGAGAGCGCGACC
GGGACAAAGGGAAGGACAGGGACAGACGGAGAGTGAAAAACGGGGAGCAC
TCCTGGGA 541. chr2_ASB1_NM_001040445_1.50429
GGTGAACGGGCACCTAGAGAGTACCCAGATCCTTCTCGAAGCTGGCGCGG
ACCCCAACGGAAGCCGGCACCATCGCAGCA 542. chr2_HDAC4_NM_006037_-1.52526
GTCAACTGAATTCGGCAGCTCGGCCGCCTGTTGCCACAGGCTCCTTTCTT
CCACGGCGTCCCTTGCGGGACCCGCCAGAGTGTGCTTGGCTTCCGCGTGT
CCGTGTGTCTGCGCGTCGCCGGCGTCTGTCCCGTGTTCCCTGTGAGGCTG
CCACGCCCAGGCGTGCATGTGCGTCTCGAGACCTGTGGGCCTGGGCGGCA
GAAAGGCTTCCCGTGGCTGTTGCAC 543. chr2_HDAC4_NM_006037_-1.60593
TGCCGGTTGAGGGGGTTCGTGCCATA 544. chr2_NDUFA10_NM_004544_-1.73584
CCCGGGCGGACGCGGACGTCGCTGCCAGCTTC 545. chr2_GPC1_NM_002081_-1.60477
TCCCGGACGCCCTTGACCCATGCCCTCCCAG 546. chr2_SNED1_NM_001080437_1.69277
GAGGGATGAGTGCCGAGCTCACCCGTGCAGAAATGGAGGGTCCTGCAGGA
ACCTCCCAGGGGCCTATGTCTGCCGGTGCCC 547. chr2_SNED1_NM_001080437_-1.511
GGTGGACGCCTGCGACTCCAGCCCCTGCCAGCATGGAGGCCGGTGTGAGA
GCGGCGGCGGGGCCTACCTGTGCGTCTGCCCAGAGAGCTTCTTCGGCTAC
CACTGCGAGA 548. chr2_PPP1R7_NM_002712_-1.77798
TCGAGTCTGAAGAATCCGGCGATGAAGAAGGGAAGAAACACAGCAGTGGC
ATCGTGGCCGACCTCAGTGAACAGAG 549. chr2_SEPT2_ENST00000429791_-1.55248

Figure 3-47

GCCGGCGACAGTGGCTCCGACACGGGCAGGCCCGGGCGCGGGAGTGGGGA
TTCCGGTGACCCCTTGTTGACCCTGCGGGAATTCCTCTGCACTGTCGTCG
GTGCTGGGCCTCGGGGCGTCGAGTGCGGTCGAG 550. chr2_---_---_-2.10908
AATTAGGCTGAGTGCAGTGGCTAACACC 551. chr2_---_---_-1.63544
GACTAAATTTGCTCTAAAGTAAGTTTGTAACAATTTACATTTCCAAAGTG
TACTCTTCTCTCC 552. chr2_---_---_-1.6091
GGGGATCCTCATGGTCTTCGGCCTGGCACCCGCCCAGGGGCTGAGACAGT
G 553. chr2_C2orf85_NM_173821_-1.5748
CGTCTGGGTTCTGCTACCTGAGCACAGCCTGGTCCCGGGATGCCTGGACG
GCGGTGGTGTCCAGTACCTGCT 554. chr2_FLJ40712_AK098031_1.5274
TGGCTCCTGTTCTACGCCTTGTCAGGGAAGATGTGGGTTCGCCCCAGGTG
CTCCAGAAAGGTCGTGTTCTCTATGGAATGAAGACGGGTGGGCATAAGCG
TGGGTCCGGGGCCACCCTCTGTCGTCCGCCGGCGTGTTTCTCATCCAGCC
ACGTCTCGGAAGGTCTGTGACTGCTGAAAACATTCTGTGCATGAACGTTG
GGGAAGGAAACCCACCCAGAGGAGGGGCAGGCGCCACCCCAGGCGTCAGA
GCACCAAGCCGCAGAGAACGGAGGCAGCAGGTGCCCGGGACACACCGGGG
AGACCGCAGGAGCAGCCCGTGTCTTCTGTGGCTCAGTCCCGCGAGAAACT
GGAGGCCAGCGCTTCACAGCTCCCATTTGCAGAGACCAGCTCCCGTGAAT
GA 555. chr3_ITPR1_NM_001099952_-1.50078
TTCTGAACCCCGTCAATGCTGGTCAGCCCCTACATGCTAGCAGCCATCAA
CTGGTAGATAACCCAGGCTGCAAT 556. chr3_ARL8B_NM_018184_-1.76633
AGTCATATGATCCGCTCGGCTTCCTGGGTCTGGCTGCTGCCGCCCGCCGG
TGTCCGCCCGTGTCGCGCCGGGGCACCAAGGAGCCGTTGGAGGGTCCGGG
CGGAGGCCCGCTCGTGTGGAAGTCGTCGACGCCGCCGCTCGTCCGTCCTC
CCGTCCGTTCTCGCTC 557. chr3_GRM7_NM_000844_1.6624
CCTAAGTGCATCAGTGGCGCTGGGGATGCTATAC 558. chr3_CAMK1_NM_003656_1.89838
ATGAGGTAGAGGTGGCCCCCACTCTCATAGATGTCATCCAGGGCTACAAT
GTTGGGGTGCTTGATC 559. chr3_IL17RC_NM_153461_-1.78718
AGAACCTCTGGCAAGCCGCCCGACTGCAACTGCTGACCCTGCAGAGCTGG
CTGCTGGACGCACCGTGCTCGCTGCCCGCAGAAGCGGCACTGTGCT 560. chr3_FANCD2_NM_033084_1.53013
TATTTGATAGTCATCCTGTTCTGCATGTATGTT 561. chr3_IRAK2_NM_001570_-1.66362

Figure 3-48

TACGTGATCACAGACCTGACCCAGCTGCGGAAGATCAAGTCCATGGAGCG
GGTGCAGGGTGTGAGCATCACGCGGGAGCTGCTGTGGTGGTGGGGCATGC
GGCAGGCCACCGTCCAGCAACTTGTGGACCTCCTGTGCCGCCTGGAGCTC
TACCGGGCTGCCCAGATCAT 562. chr3_TATDN2_NM_014760_-1.7251
CTTGGGGACCGAAGGACTGTCATTGACAAA 563. chr3_ATP2B2_NM_001001331_-1.72536
CGCCGGGCGGGTGGTAGAAGGACAGCCCCAGGGAGATGATGGCGGCAATC
TCCAGGATGATGAGCGTCACGTCCTGCAGCGCCTCCCACACGAGCTGCAG
GAAGGTTTTTGGCTTCTTTGGAGGTATAAAGTTTTGCCCAAAAATTTGCT
TTCTCTTTTCCAGGTCTGGAGCGGTGCCCGGCAAAC 564. chr3_SLC6A11_NM_014229_-1.61946
TGGCCTTTATTGCGTACCCCAAGGCGGTCACCATGATGCCTCTCTCCCCG
CTGTGGGCCACCTTGTT 565. chr3_SYN2_NM_133625_1.53411
TACAAACTGTGGGTGGACACCTGC 566. chr3_TMEM40_NM_018306_1.73131
GGCTCCGTCGATGTTTTCCGGTTGCTCTGGGTTGCTGGTCCTCA 567. chr3_IQSEC1_ENST00000450726_-1.77926
GCCACAAACAGCCGCAGCCTGGCTG 568. chr3_NUP210_BC067089_-1.57248
CAACAGCCCAGATAAGGAATGAAAACCAACAGTGGGGACCGATGGCCCAA
GCT 569. chr3_NUP210_NM_024923_-1.54406
GCTGTGGTTCCTGATGCCTCGTGAAC 570. chr3_NUP210_NM_024923_1.87894
GGCCAAGGACGAGGCTGCTCTGTCCCA 571. chr3_C3orf20_BC030599_1.77009
CAGGAGACCCTGAACAGGTTTCAG 572. chr3_EAF1_NM_033083_-1.53291
GACGCCAGCGCCAGAAGCTCGGATCGCGGCTGCACCGGGAGAGCGCCGAT
CTGGGTGCGAGGCA 573. chr3_COLQ_NM_005677_-1.55952
CCCTTTGGTCCTGTCTTGCCAGGAAGC 574. chr3_TBC1D5_NM_001134381_-1.74806
AGAGACCTTATTTATATTCAGGGGAGCACC 575. chr3_THRB_NM_000461_-1.5755
GTGCCCTGGAGCCGGTTGGGTTGAGCGCCCCTGCCCGGGGAAGGTAGCCT
GCGGGCTCTTGCC 576. chr3_TOP2B_NM_001068_1.71006

Figure 3-49

TCCTAGCCCGACCGGTTCGTGGCAGAGAA 577. chr3_AZI2_NM_022461_-1.59825
CAGAAGCCAGGCTACGTAGGGCCGCCCCCAAGGCCGCCGAGTTTCGATTC
CTTAGTGTTTGG 578. chr3_CCR4_NM_005508_-1.50515
ATAACTCGTGCTCACAGGAAGCCACGCACCCTTGAAAGGCACCGGGTCCT
TCTTAGCATCGTGCTTCCTGAGCAAGCCTGGCATTGCCTCACAGA 579. chr3_UBP1_NM_014517_-1.51108
GGCCTCCGCGTCCAGGGCGAAGGAGCC 580. chr3_PDCD6IP_NM_013374_-1.64996
TATCTGCCTTAAGTCGAGAGCCGACCGTGGACATATCTCCAGATACTGTT
GGGACCCTCAGTCTTATTATGCTGGCACAGGCTCAAGAAGTATTT 581. chr3_LRRFIP2_NM_006309_1.5946
CCTGGACTGCTTCGGGCTGAACTTATTCTTGATGAA 582. chr3_VILL_NM_015873_1.55135
GCACCAGCGCCACGATCAACGGGGGCCTGCGCCGGGAACAACTGATGC 583. chr3_PLCD1_NM_001130964_-1.57598
TGGTGATGACAGCAGTCTGGCGGCTGGCCACGTCCCGGCTCACGCCATGG
ATCTCCACTGT 584. chr3_DLEC1_BC129824_1.57596
GGTGTCTCCCACATGTCTACTATGGCAAAAAACATTACCATCCCCACCCA
TACCACAGCATCCCCTAGAGAGAGTGAGGTGCAGGGACCCGAGGGCCAGG
TTAGCACAGCGCTGGCCCCAGCATGGAGGGAAGCCCTGTGGGCCACGGTA
GGCTAGAAGGGAATTCGAGCTGGGCATGAAAAGGATGCTCCGGGGCCATT
GTTAGTGGGTTTGGGGCTGAGATGAGTGATCCTGCCTCTGGTCCCAGCAT
CCAGCTGCCTCGTTGTCTATCCTGGGAGGGTGTGGTGCTTCGGACACGTT
GAGGGGCTTTGTCAGCATCAGGAAGGCCTTTGCTTCTTGCACCCAGGCCC
AGCTGAGACAGGCCCCTGAGTCCTGGCTCATGTTCTGGCAGCAACTTCAC
TTTTCCTAAGGAGGGGAGGAGGCAGCAGGGAAGCAACCCTGGGTTTTCAG
AAGGTCCTTCTGATGGCTAGGCTA 585. chr3_XYLB_NM_005108_-1.69199
TCTTTGGTCAGTAGCTTTGCTGCTTCCCTGTTCCTTGGCTCTTACTCCCC
TATTGACTACAGTGA 586. chr3_ACVR2B_NM_001106_-1.88369
CTCGCCCTCCTCTGGGGATCGCTGT 587. chr3_SCN5A_NM_198056_1.67235
TGAGCCGCGGGCTTGCTTCTCTGCCATGCGCTTCTCGATGGCTGCCAGGG
ACTCCCGTGTGAACCTGCGGAAGCTGCTGGTGCCCCGAGGTAATAGGAA 588. chr3_CSRNP1_AB063301_1.61569
AGCGTTTCCACCCTCACGCTTTTACTGCAGCCGGTCTTCTCGACTGGAAT
GC 589. chr3_XIRP1_NM_194293_-1.58612

Figure 3-50

GGTGTTTGTGGTCTGTAGCAGCTGTGGTCTCAGGGTTCGTCGTTCCTCTG
GAGGTTCTTGTTCAAATTGGTTCTGTTCTGCTGGC 590. chr3_MYRIP_NM_015460_1.84272
GGCCCAGAGCTCTGACCAAGGCCCCATAGCTGCCTCCCCATCCTCTGCAC
TCTCCCCCAACCCTGAGGCCATGTGCTCTGACTCGGAGACCTCCTCCGCA
G 591. chr3_ZNF619_NM_001145082_1.55451
GATATTCCAGCTGGAGCAAGGAGA 592. chr3_ZNF621_NM_198484_1.59112
ATGGGCCAGCCTCGACCCTGCGCAGAGGG 593. chr3_CCK_NM_000729_-1.66127
GGTACTCATACTCCTCGGCACTGCGACGGCCAAAATCCATCCAGCCCATG
TAGTCCCGGTCACTTATCCTGTGGCTGGGGTCCAGGTTCTGCAGGTTCTT
AACGATGGAC 594. chr3_VIPR1_NM_004624_-1.52046
GCAGGGCGTCCTGGGCTGGAACCCCAAATACCGGCACCCGTCGGGAGGCA
GCAACGGCGCCACGTGCAGCACGCAGGTTTCCATGCTGACCCGCGTCAGC
CC 595. chr3_VIPR1_NM_004624_1.53645
GCTTCCAAGCCGAAGTCTCCCTGGTCTGA 596. chr3_C3orf23_NM_173826_-1.6452
TTTGCCACCTGAGACCTATGAGGAG 597. chr3_ZNF167_NM_018651_-1.72627
GTGTCCGGCTTCGGTGCCGAGTGCCACCGCGAGTGGGCCGAGACGCGGAG
GGAGGCGCGGCCGGAGCTCGGGTCGCCGACGCTGGCCAGGACCGCGCTTC
TTCCCGGCG 598. chr3_LTF_NM_002343_1.78491
AGGGCCACGCACTTTTCTCATATTCCTTTGCCATTGGAAGCATTTTGTGG
CCTCGGGTTGGGATACGGCGCACCACTGAACACT 599. chr3_LRRC2_NM_024750_1.69728
AGGCATTTCTACCCGGCTGTGGTAAGCGGAGGTTCTCCTCTT 600. chr3_ALS2CL_NM_147129_-1.66276
CTGAGGGTTTATTGGTCAGGGCCCAGGCAGATGTCATGTGCCCCTGTTGT
CCCCACGCAGGCCCACAGACATCACAGGAGAATGATTTACAAGCCACTTG
GGGCCTGCTGGCAGTGAGGGTTTACCCACCCCCCGCCCCAGCTTGCTCCA
GTGCCGCCGTTTACGTCATGGGTACGTGGCCTGCAGTTCACGGATCTCCA
GGCCCATCCTGTTGACTGCATACCCAGTGAGGCT 601. chr3_NBEAL2_NM_015175_-1.6203
CATACACACTGTACGCCGCGGACAGTTTGTAGCGGCACTACGGCCTCTGG
GTGCCACATTCCCTGGACCTATTTTCCACCTGGCATTGGGGTCCGA 602. chr3_SETD2_NM_014159_2.06264
TACACTGACAGACTGTTGGTTTGA

Figure 3-51

603. chr3_PTPN23_NM_015466_2.06921
TAGATAGCATCCAGGCGCCCATCCC 604. chr3_PTPN23_NM_015466_-1.83244
ACACAGCCCCACGGCCAAACCCCA 605. chr3_SCAP_NM_012235_1.952
AGGAAGAAGTCAGACACCAGCCCC 606. chr3_FBXW12_NM_207102_1.51175
GATCGCAAGTTTCCAGGTGGCAGCTCATCTGAAGTGCCCTATCTGGATGG
GAGCCAGTGATGGATATATGATTGTCTTTACCAGTGGACCATACTTGTTA
CTCTTCAGCATCACTGGCTTCCTGCTGCAACGATTTGAGGACCATCAGGC
AGCCATCA 607. chr3_PLXNB1_NM_002673_1.71047
GGATTCTTGGCGTCTGTACCACGTCCAGATTCTGGCCACGGACGCATATC
TCAC 608. chr3_---_---_1.52448
AGATTGGGGAGAACTGTGAACACAACCAGCCCA 609. chr3_SHISA5_NM_016479_1.5989
CTGACATGGGGTCGTTGTAGCCAGGGCGAAACCTCAGCGCCGAGCCCAGC
TGCTCCACCGGCTCTACACTGGCAGGCA 610. chr3_COL7A1_NM_000094_2.58823
CTCCCTTCTCGCCTCGAGGACCGGCAGGCCCTG 611. chr3_COL7A1_NM_000094_1.54306
CTTGGACTCCGGTAGCTCCTCTGGGCCCAG 612. chr3_COL7A1_NM_000094_-1.92914
TCCAGGACGTCCAGCAACCCCTGGCAGCC 613. chr3_COL7A1_NM_000094_1.51099
GCCAGTCTGTAAGCTGTGGCTCCAGTGACCCCTACCCAGGTGATCCGTAG
AACGTCGCTGGAAGCATTGAGGATCTGCAGCCTCGACACAC 614. chr3_IP6K2_NR_027437_1.61768
TGGAGGACAAAAAGCAGGCGGCAAGTATT 615. chr3_WDR6_NM_018031_-1.60013
CAAACCTGTAGCACCTGACCGACGAATCAGTGGGCATGTGGGCATCATCT
TCAGCA 616. chr3_WDR6_NM_018031_-1.69703
CAGAAGCTGCAGGCGGACGAACATCTGACCAAAGAGGTGTGGT 617. chr3_QARS_NM_005051_-1.53972
GAGACGCCGGGTATCCCTGAGTCGGGAGGCCAAGCCATATAACAGGATCC
CGGTAGCTTTGTCAATGGTGGAACCCAGGGTCTGC 618. chr3_CCDC36_NM_178173_-1.58545

Figure 3-52

ACTAACTGCAAGAACTGGGCTGTTACTAAAACAGGTGCCAAGAACCATGG
TTCCAGCGTCCCAGGCCATAAGATTCCCAGTGACAGGGACCTGGTTTCCC
AAGGAGCCTCACAGCTCACATCATTGGAGATA 619. chr3_---_---_-1.74658
GAGGTTGCAATGAGTGGAGGTTGCAATGAGCTGAGATTGCACCACTGCAC
TCCAGCCTGGCCAACAAGAGCGAAACTCCATTTAA 620. chr3_---_---_-1.53917
GGGCCACTGCACACCAGCCTGGGGACAGAGTAAGACTCCATCTCAC 621. chr3_AMT_NM_000481_-1.68027
GCGAGCAGTGCTGGCGTGTGTGCAGGTGCGAGTCAGTGTGACTGTCCCGG
TACTGCACTGGCAGACTCCAAC 622. chr3_RNF123_NM_022064_-1.70291
TATGGCCTACTTCCCAGCCATCAGCCTCTCTTTCAAGGAGTCCGTGGCCT
TCAACTTTGGCAGCCGTCCTCTGCG 623. chr3_MST1R_NM_002447_-1.74381
ATAAATACATGTTGCAGGACTGCCCTCACTGGCTCACTCTGTGGAGTGAG
GGACCTAATGGGCCCCATTTACCTATTGCCTCTGAAAGTTAAAGGGCAGG
AACAAGGTGGAGGGCCACTGCCCTCTGGCCTGGCATGGCCCAGAGGCAGC
TTGGGGTTAGCTCAAGGCAGCTAAGCAGGTCCAGCCCAAGAAC 624. chr3_RBM5_NM_005778_-1.51467
CAGTGACCGATCCGAAGATGGCTACCATTCAGATGGTGACTATGGTGAGC
ACGACTATAGGCATGACATCAGTGACGAGAGGGAGAGCAAGACCATCATG
CTGCGCGGCCTTC 625. chr3_SEMA3F_NM_004186_1.51787
ATCCAGCACCCGTCAAGACCATGACCATCTCTTC 626. chr3_GNAT1_NM_144499_1.5271
CACCTACGAGGACGCCGGCAACTACATCAAGGTGCAGTTCCTCGAGCTCA
ACATGCGGCGCGACGTGAAGGAGATCTATTCCCACATGACGTGCGCCACC
GACACGCAGAACGTCAAATTTGTCTTCGACGCTGTCACCGA 627. chr3_GNAI2_NM_002070_-1.63841
ATCATCCACGAGGATGGCTACTCCGAGGAGGAATGCCGGCAGTACCGGGC
GGTTGTCTACAGCAACACCATCCAGTCCATCATGGCCATTGTCAAAGCCA
TGGGCAACCTGCAGATCGACTTTGCCGACC 628. chr3_GNAI2_NM_002070_-1.56396
CCACCGACACCAAGAACGTGCAGTTCGTGTTTGACGCCGTCACCGATGTC
ATCA 629. chr3_SEMA3B_NM_004636_-1.5992
TGTGGAATGGCGAGAGGAGTGCAACTGGG 630. chr3_SEMA3B_NM_004636_-1.91312
CTGAAGGTGATCTCGGTCCCCAAGGGCA 631. chr3_IFRD2_NM_006764_1.50464
ATTCACTGGCGGTGCTGCGGGCCTCACTGGCTGCCTCATCGTCACTGGAA

Figure 3-53

CCCGAGTCAGCTTGGGCACTG 632. chr3_HYAL3_NM_003549_-1.57782
GCCTCCTCCAGGCGATGTCGGACAAAGGCC 633. chr3_CACNA2D2_NM_001005505_-1.73487
CCACTGCAGCGGTGTGACGTCATAGTTATGCTGCCCCACGGAGAAAGTAA
ACACGCGCAC 634. chr3_MAPKAPK3_NM_004635_1.57505
AGTGCCTTGGCCACTATGCGGGTAGACTACGACCAGGTGAAGATCAAGGA
CCTGAAGACCTCTAACAACCGGCTCCTCAACAAGAGG 635. chr3_DOCK3_NM_004947_-1.74356
AACAAGAAACATGGCGCGAGACCGGCATTTCCTTTGTGACCTCAGTCACC
CGCCTCATGGAACGTCTTCTTG 636. chr3_TEX264_NM_015926_-1.52674
AGCGGAAGCTGTGTGCCTATCCTCGGCTGGAGATCTACCAGGAAGACCAG
ATCCATTTCATGTGCCCACTGGCACGGCAGG 637. chr3_PARP3_NM_001003931_1.61908
GGACACTGAGTTGGAGCTGGATGGCCAGCAAGTGGTGGTGCCCCAGGGCC 638. chr3_ACY1_NM_000666_-1.59792
TCTCTGAAGTACTAACACAAGGACA 639. chr3_TLR9_NM_017442_-1.81051
TGCACCAGGAGAGACAGCGGGTGCAG 640. chr3_TWF2_NM_007284_-1.54162
TTTTTCACTGTGGCCCGCGTGGCCGCGTACA 640. chr3_DNAH1_NM_015512_1.78059
CCACCATCATGGTGTATGCAACCATCACCTCCCAGCTGCTGCCCACTCCA
GCCAAGTCCCACTACACCTTCAACCTGAGGGACCTCTCCAAGGTCTTCCA
AGGCATGCTCATGGCTGACCCGGCCAAGGT 642. chr3_SEMA3G_NM_020163_-1.66875
GGGGCCAGAGCTACCCCCATGGAGCAGGAGGCCCCCTAGCAGCCAGCAAA
TGGCCCAGGCCGAGGG 643. chr3_NISCH_NM_007184_1.76023
TGAGCTGCCTGTCGAGCTCACCGGCTAG 644. chr3_STAB1_NM_015136_-1.60813
GAGTGTGTCTACATCCATGACCCAACGGGGCTCAATGTGCTAAAGAAGGG
CTGTGCCAGCTACTGCAACCAAACCATCATG 645. chr3_NT5DC2_NM_022908_2.10164
GGACTGGTAAGGATTGAGGCCGTAGGATGGGCTCGAGTGTGGCGGTGTCC
CCAGGGCCCCAGTGAGCAAGTGGGTGTGCTGGGAACCTGGCCACAAGTGA
A 646. chr3_PBRM1_NM_018165_1.58677

Figure 3-54

GATGAAGACACAGTCGCCAACCTTCAGCCACATGTCATTGTAATGGAGCT
GCTCAAAGTAGTGGCAACCTGGTTCACCATTGGACA 647. chr3_ITIH3_NM_002217_-1.91317
AATCCTGGAAGATATGCAAGAGGAAGACTATCTGAATTTCATCCTGTTCA
GTGGAGATGTGTCCACATGGAAAGAGCACTTAGTCCAGGCCACGCCCGAG
AACCTCCAGGA 648. chr3_SFMBT1_NM_001005159_-1.66781
AACACTTATCCAGAACCATCCGTGGACCGAAGAGGTTAGGACAGCATTCC
AGTTTGATACAGGTTTGCCGGCAGAA 649. chr3_RFT1_NM_052859_3.27036
GCCGGGCCGCGTGGCCCAGCACCT 650. chr3_WNT5A_NM_003392_1.65362
GTCTGCACGGTCTTGAACTGGTCGTAGCCACGGCCGCAGCACATGAGCTC
GCAGCCATCCATGCCCTCCGACGTCTTGTTGCACAGGCGGCCCTGCGTGC
CCAGCGAGCCGGTGCTCTCATTGCGCACGCAGTAGTCAGGGCTGGGGTCG
ATGTAGACCAGGTCTTGTGTGGTGGGCGAGTTGAAGCGGCTGTTGACCTG
TACCAACTTGCCCCGGCTGTTGAGCCGCATGGCCGCCGCGCTGTCGTACT
TCTCCTTCAGGGCATCACCCACCTTGCGGAAGTCTGCCAGCTGCAGCCAG
CATGTCTTCAGGCTACATGAGCCGGACACCCCATGGCACTTGCAGGCCAC
ATCAGCCAGGTTGT 651. chr3_APPL1_NM_012096_1.55967
CAGTTTTACTTCACGCAGGGTGGAAATTTAATGAGTCAGGCCCGTGGGGA
TGTAGCAGGAGGCCTGGCCATGGACATAGACAACTGTTCAGTGATGGCTG
TGGACTGTGAAGACAGACGATATTGTTTTCAGATCACC 652. chr3_FEZF2_NM_018008_1.51762
TTGCCGCAAAATTCGCAGACGAAGGGCTTGTAGCCCGCGTGGATGCGGAT
ATGCGTGTTGAGCGTGGAGCTGCGGTTGAACGCTTTGCCGCACTGGTTG 653. chr3_MITF_NM_198159_-2.23534
CGGGGAGCAGCGCACCCAACAGCCCC 654. chr3_EIF4E3_NM_173359_-1.53635
AGAGGCGGGACTAGAACGTGGGTAGCTTGAGGTCCGGACCAACGTGCTGT
CCCACTGCATGACACGCAACACAGACGACTTGGGGTGGCAG 655. chr3_GPR27_NM_018971_-1.70997
GCCACGACTGGACCTTCCACGGCCCGGGCGCCACCGGCCAGGCGGCCGCC
AACTGGACGGCGGGCTTCGG 656. chr3_TFG_NM_006070_-1.59708
GCGGCGGTCGCGAAGGGCAACCGAGGGGGCCGTGACCACCGCCTCCCCGC
GACGCCCCAGTCCAGTGGCCTCGCGTCCGCCCATTCAGCGGAGA 657. chr3_ABI3BP_NM_015429_1.5074
AGGGAGTCGCTCAAGTAAATCTTGTATCTGAGAGAGTTGCACAGCTGCAC
TCCTACAAATTTTTTATACCATGTCCTTTTGACATATTGTTTGCCCTTAC
ACTCTGAGTAAGAGTCTGA 658. chr3_ZBTB11_NM_014415_1.61615

Figure 3-55

GGAGCGGCGGCACCGTAGGGAGAAACGGCTGCGCCTTTGGCGAGCGCTCT
TCGACGGCT 659. chr3_FAM55C_NM_001134456_1.72037
CTAACAGTCTAGAACTATCTCAAG 660. chr3_NFKBIZ_NM_031419_1.59345
GCGGCCTCATGACCAGCCCGCTCAACCTGAGCTACTTCTACGGCGCGTCG
CCGCCCGCCGCCGCCCCGGGCGCCTGCGACGCCAGCTGCTCGGTCTTGGG
CCCCTCGGCGCCCGGCTCGCCCGGCTCCGACTCCTCCGACTTCTCCTCTG
CCTCGTCGGTGTCCT 661. chr3_ALCAM_NM_001627_1.54862
ATAGTAAAATTATCATTTCCCCTGAAGAGAATGTTACATTAACTTGCACA
GCAGAAAACCAACTGGAGAGAACAGTAAACTCCTTGAATGTCTCTGC 662. chr3_CD47_NM_001777_-3.51447
ATTAAGGGGTTCCTCTACAGCTTT 663. chr3_CD47_NM_001777_-1.9829
AGCCCAGCAACAGCGCCGCTACCAGGGGCCACAT 664. chr3_DZIP3_NM_014648_1.5506
GCCTTGAGTACCTTGCCTCCAGTCCAGCT 665. chr3_C3orf52_NM_001171747_1.64059
CTGGTCTCTGTCTGAAAGCAGTGCTCTACCAAGTCCTGGAGATGAAGGGA
ATTCACTCTGTTTTGCAGAAAAGATTCTGTGGATTAATACAGAAGCACCA
GCAACACCAGAGGGGTGGAGACTCCTTTCTCTCCCGATTCTACAGTCTGG
CTCTAAGCCCAGTAAAACAGCTCCCGAGCACTGCTTCAGCTGGGTCCAGT
CTTGACA 666. chr3_ATP6V1A_NM_001690_-1.63818
GCAGCTTTGAGACTAGTGCCTATGTGTGTTATTTGTTTCCCTGTTTTTTT
GGTAGGTCTTATATAAAACAAACATTCCTTTGTTCTAGTGTTGTGAAGGG
CCTCCCTCTTCCTTTATCTGAAGTGGTGAATATAGTAAATATACATTCTG
GTTACACTACTGTAAACTTGTATGTAGGGTGATGACCCTCTTTGTCCTAG
GTG 667. chr3_UPK1B_NM_006952_2.1123
CATCTTGTATCACAGCAGCAACAC 668. chr3_C3orf1_NM_016589_-1.50848
ATCTGCACATCGTGCTGCCACACGAGGCTTCATTCGTTATGGCTGGCGCT
GGGGTTGGAGAACTGCAGTGTTTGTGAC 669. chr3_POLQ_NM_199420_1.52914
ATGAATGATTTTGCCTGGTCCCAGTTAATTTTGATTTTTCAGCCCTTTCA
TCTTGATCTCCTCCATCTTGATCACCTTGGTGGTGCTCATCAAGTACTGG
ATCACTTAGTTCTAATGCTCTAGGAGATACTACAGTATGATTCTTCTCTT
GGACAGGAAATATATCCACATTGTCCAAAGCTTCAACCATCTGAACAGAA
TCCATTTCTGAAAATATAATAGATTCATCATTGGAACAAGTCAACTGCTG
GTGGGTATCTTGATTCTCATTTACATTTGATTTTTTAATTAGGTCTTCTT
GTAGACACAGAGAATCACTAAAATGGTTTGATGTTACTTCTGAAGGAAGG
GGTTCTTTCATTTGCATATCAGGTAATTGTTCTTTTACTAGATAGTCATC

Figure 3-56

ACTGAAGCTATCAAATAGTAAACTATCACTCATATTCAAACTTGTTTCAG
GAACTGGAAGACATTCTCCTTCTACACCAGTGGGAGTTCTCTTTTGAGGA
ATCAGAAGTATAACTGGTTTCACAGTTTCTTGTGTTTGATAACCTTGAAG
AAAACTATTTAATTGTGAATCAGTAACAGAAACTTCATTCTTTTTTAAAA
AAAGACCATTTTCCTCCAATAGTATTGGAGAATGGAAAATCGGGCTTTCT
GGAGTCAGGATATCAACCCCATGTGAATCACTGCTTTGTTTCATAGTACC
TACAGTCTTAAGGTCCAAATGATCTATCTTAGTCGCTCCTAGAGGGTGC 670. chr3_PARP14_NM_017554_-1.53311
TAAGCATTATGGTGGCCTGGCCGCTGCGCTCTCAAAAGCAGCTGGCCCTG
AGCTCCAGGCCGACTGTGACCAGATAGTGAAGAGAGAGGGCAGACTCCTA
CCGGGCAATGCCACCATCTCCAAGGCAGGAAAGCTGCCCTACCACCACGT
GATCCATGCAGTGGGGCCCCGCTGGAGCGGATATGAGGCCCCGAGGTGTG
TGTACCTATTAAGGAGAGCTGTGCAACTCAGTCTCTGTCTAGCCGAAAAA
TACAAGTACCGATCCATAGCCATCCCAGCTATTAGTTCTGGAGTCTTTGG
CTTTCCCTTAGGCCGATGCGTGGAGACCATTGTTTC 671. chr3_SEMA5B_NM_001031702_-1.73102
CCCACGATGAGCTGGTTCCCGGAGGGGTCCAAAGCCAGCTGGGAGAAATC
CCGGGCTCCAGGGTAGGTGAAGTTAGAGACCCACGGCTGCAGGT 672. chr3_PDIA5_NM_006810_-1.54911
ACTTCAGACGGCTCCTGAAGAAGGAAGAGAAGCCGCTCCTGATCATGTTT 673. chr3_ADCY5_NM_183357_-1.56098
ATGCGGTCGGGTACACCGGTGCTGTCCATGCGGCTGGCCACGTTCACGGT
ATTGCCCCAGATGTCGTACTGAGGCTTTCGT 674. chr3_ADCY5_NM_183357_-1.53153
GGCCTCCAGCTCAACGTAGAACTCGGAGAAGTTGGCGATGGAGGCGAACA
TGACCGCCACACACTCACAGGACTGATAGTAGAGCTCATCATTGCGCCGC
TCGC 675. chr3_ADCY5_NM_183357_1.59184
GGTCGTCACCGCTCAGCGGAGGATCGTCGTCGTCGTCGCTGCGCCAGCGG
CTGGCCAGGCGCTGCTGCTGCTGCGGGGTCACCGCCCCCCCGGGTTTCTT
GGTGGAGCCGCGGGCAGAGCCCCCGGGGGCATGGGGGTAGCCATTCGCGC
GGGAATCGGCCTCGCCCCACGCAGAGCGGTGTTCGGGGCCTCCCCGGGGC
GCCGGCGCCGCAGTCTTCTGCGCCCGCGTAGCCCGGG 676. chr3_MGLL_NM_007283_-1.9294
AAGCCCAGGGTAGTCTTTCTGCAT 677. chr3_SEC61A1_NM_013336_1.57586
GCTGTGGACCGCTATCACCCTCTTTATCTT 678. chr3_RUVBL1_NM_003707_1.6445
AATGGCCCTGCGGAAGTTCTCCATCAGCA 679. chr3_GATA2_NM_032638_-1.63578
CAGAGCCTGGGCGGCACGCCGAGCGGCCGCAT 680. chr3_C3orf27_NM_007354_-1.55094
GGCTGTCACCAGAGAGCCCGACGGCTTCAAGGAACAC

Figure 3-57

681. chr3_ACAD9_NM_014049_-1.5433
CCTGCAGGCAGTGCTCTCTAACAG 682. chr3_C3orf25_BC066975_-1.64183
GCCTCTGAAGGCGTGATGCTGGGCTTGTTCTCCAGCCACCTCTTTACATC
ACCAAAGGACTCTAGCTCCTGCCGCAG 683. chr3_IFT122_NM_052985_2.45923
GCCCGAGCCGTAAGGGAAGCCGTG 684. chr3_PLXND1_NM_015103_1.59837
GGCGCGGCGAGTGCATGGGGCGAGGCGCGGCCGGGAGCCGGGAGCCCGGA
GGCGGCGGGAGGCGGGGGGCGGCCCGGGCCGCGATGCGCTTCCTGCCCG
CGCCAGCCGCCCCCGACCCCGGCGCCCGGGCCCGGGTCAGCCTCGCCGCG
CAGCCC 685. chr3_ATP2C1_NM_014382_1.53848
CTTGGAGTAGAACCAGTGGATAAAGATGTCATTCGTAAACCTCCTCGCAA
CTGGAAAGACAG 686. chr3_ASTE1_NM_014065_1.53524
CTGGCTCCTGCACGTGAGAGTCCAATCTCAAGAGCGGGAATCGGAAGTCT
CCCGGTGTGACGTCTCTGGGAAGTACAGTTCCGTGATGCCGGTGGCGC 687. chr3_DNAJC13_NM_015268_1.71641
TGGTATTTTGGCAACGCAGACAAAGAAAGGAGTGGCCCGTATGGATTTCA
TGA 688. chr3_---_---_-1.73935
CGCGATCGTGCCACCGCAGCGAGACC 689. chr3_BFSP2_NM_003571_-1.73221
CTGCAGACAGAAACTATCCAGGCCGGAGCAGATGACTTTAA 690. chr3_BFSP2_NM_003571_-1.55464
CAAACAGTTGGCAGGGTGTGAGCTGGAACAAATGGATGCTCCCATTGGCA
CTGGTCTGGACGACATCCTTGAGACGATCAGAATTCAGTGGGAGA 691. chr3_AMOTL2_NM_016201_1.66302
GCGGTGGCTAAGAACATGCACATTCTTGAATGTCCTCTGCATGGTGCCTG
GCCTTCTGGATGGTTTCGGACAAAACTTTATGTGCTAGGTGGGAGTGGGA
AAAGGAGTGGGGGAAGGATAAAGCCATCTTTGGACACCCACTCCCACTGT
GGATAACCACAGCGTGTGGCCGAACAAAGCTGATTAGAACACAGCCCTAC
CTCGGGAGGCTGCCATCTGCCAGGCCCTCCTTCCCCTCCCAGCCTTCAAG
AAATGTTATCTATGAAAGGGGAAAAATGCCAGCCACATCCTCATTCCAAC
TCTATCCTTAATGCAGCTTCACAAAATTCCTAAATTCTATCTTGGGTCCT
TGAAGAGATTGGACTATGACTTGGGTGGCCCC 692. chr3_EPHB1_NM_004441_-1.54447
AATGGACACCAGAACGGCTACTGCAGAGCTGGGCTGGACGGCCAATCCTG
CGTCCGGG 693. chr3_MRAS_NM_012219_-1.52558
CACCTAACTGCACTGAAACCATTTCTAACCACAACCCTTGGCCCAAGGAC
TTGGTACAGGAAGGGAGAAGGGCAGGTGGGCAGGGAGCAGACAGGGTCTG

Figure 3-58

GCTTTGCCCAGAGGGCACGGGCTTTCCCACCTCTCAAAGAGACAAGGAAG
CCACCTGTAAGCAGAAGCAGCATCCAAGTGCCCCTGGCCCCCCCATGTGT
TGATTCAACCCGGTTCCTCCCCCTCTCTCGGTGGGTGTGTTGTTT 694. chr3_FOXL2_NM_023067_-1.55016
GAGGCTGCGGTAGCGGCCACGAGTTGTTGAGGAAGCCAGACTGCAGGTAC
TTGGGGGGCGCCAGGTAGCCGTAGCCGTCG 695. chr3_GK5_NM_001039547_1.55938
TTCTGCACGCTGGAGCCGCAGACCCGCGCCGCCCGGTCATAGACGTGGCA
GCGGATCACAGAACTGCCCACATCCAGCCCCAGCACGAAGCCGGGGTACC
GCGGCTCCTGCGCTCTCTGCTCCGGGTCCGTGAGCAGC 696. chr3_CHST2_ENST00000309575_-1.63861
CCGACAGGGGATTTCTGCCCAAACTTCATCACCAACTCTTTCTGAGAGCA
AAAACATGGGGCCGAGTCCGGCAGCTGCACGCAGAATCCAACTCTCTGGC
AGCTCTCGGCACCGACGAGCTCCAGATCCCGCGTTCGCATCCCGGCGCTT
TGCGCGCAGAGCTAAGCCTTCGGACCCGTGGACTGCA 697. chr3_CHST2_NM_004267_-1.64137
TCCTTTGGTCCAGTCGGAGGCTGCGGAGCGGCGGGGGTTGCCTGCGCTGT
CCGCCCGGGCATCCTCCCGGTGATGGAAGCAGCCGCCGC 698. chr3_SLC9A9_NM_173653_-2.36624
TCGGCAGACAGGAAGGCACTCCAA 699. chr3_WWTR1_NM_015472_-1.52356
CGCTCGGGTGAGTCCCGAGATTGCGGAGCTGGAGCCGAGGCTTGGCTGAC
AAATCCCGACCCGACTCTGTGCCTGGCAGTCTAAGGGCTTCGGCTCTCAC
ATCCCCCGAGCTGGCCTAAGGCGCTAGTGCTGGGCGAAA 700. chr3_EIF2A_NM_032025_-1.60712
TGATTTTGTATTATCACCTGGACCCCAACC 701. chr3_LEKR1_NM_001004316_1.57353
CTTTTCTTCAGGAGACAGTGCGTAGAGAATGTGAAGAACGCTTTGAACTG
ACAGAGGCTTTGAGTCAAGCCAGAGAACAGCTCCTGGAGCTCAGTAAGCT
TCGTGGAAGTTTACCATTCTCACCGTGTTCCCTCAGCAAGGGCAGCCTAA
CCTCCCCTGCTGCAGCAGTCAGTAATCATGGAGAGAGAAGCCTTGCAAGA
CTGAACTCTGAAAAAGGAATCCAAATTCCCAACCTGCGCGGGGTGTCA 702. chr3_SCHIP1_NM_014575_1.73501
GATGACCGCTCTCCGGCCCGGGAACCGGGGGACGTAAGCGCCAGGACCCG
CAGCGGCGGCGGCGGGGGCAGGAGCGCCACCACCGCCATGCCGCCCCCGG
TGCCCAACGGCAACCTCCACCAGCACGACCCCCAGGACCTCAGGCACAAT
GGCAACGTGGTGGTGGCTGGCCGGCCGAGCTGTTCCCGGGGCCCCCGCCG
GGCGATCCAAAAGCCCCAGCCGGCTGGGGGCCGGCGCAGTGGCCGCGGCC
CGGCGGCTGGGGGGCTCTGCCTTCAGCCCCCAGACGGCGGGACGTGCGTC
CCCGAAGAGCCCCCGGTGCCACCTATGGATTG 703. chr3_SCHIP1_ENST00000445224_1.54769
CCCGCCGGTGGATGCTCCGCGCCTGCCCTCCGCAGCCTCGCTCAGCAGTC
CTGCGTTGGGGTCTGCGCCCTAGGATGCACTGAG 704. chr3_SMC4_NM_005496_1.60186

Figure 3-59

TTCATTGGCTTTAGTATTTGCTCTTCACCACTACAAGCCCACTCCCCTTT
ACTTCATGGATGAGA 705. chr3_MECOM_NM_001105077_-1.67398
GTTTCATGGGGATAGTCTTCGCTCTTCAT 706. chr3_LRRC31_NM_024727_-1.93913
GAAGTTGATGGGGGTAGTTCCCAATAAGACATCTTCCTG 707. chr3_GHSR_NM_004122_1.89073
AGGCACAGGGAGAGGATAGGACCCGCGAGAGAAAGCCTGAGCGCGCGCTG
AGACCCA 708. chr3_ZNF639_BC026181_-1.82341
GTGCGGCCGCGGAGCCTAGGCCAGGGGCCTGGCGCTCAGGGCGTGGGGCG
CGCGGGGAGGGAGAGGGGTCGGCCCAGCACAGCGTCCGGGAGCGCTAGGG
CCGGAGCAGCGCTGCCCGCCGCCGTGCGTCCGCGGGAAGGAC 709. chr3_MCF2L2_NM_015078_-1.70546
TCCCCGGGAGTTCAACTCTGTCTCCGTATAAGGTTCCTCAGACGTTCTCA
GAGGACGAGCTAGAGG 710. chr3_EIF2B5_NM_003907_1.58829
TCGTGGCGACCACAAGTCCTATCACGCCACAAGAATCTCGGCTTGTTCAC
CTACAAATGAAGGCCGACGATACTTGCAGACCGAGTCTGACATCTATGGG
ACCC 711. chr3_ABCF3_NM_018358_1.66824
TAGAGAAGGCCGAGGCTCGACTTAAGGCAAAGCAGGAGAAGCGCTCAGAG
AAGGACACGCTCAAGACCAGCAACC 712. chr3_ABCF3_NM_018358_1.58829
GACATGGACTGGTCTCTCAGACCCCTGGGCCACCATGTAGGCCACCACTC
CAGGCCGTGGACTTCCCCCAACTTGGGGACAGCCTTATTCCCAAATGTCT
CTATCCTTTTGACTGGAGCATCTTCTGCACAACCTTGGGAGCCCATCCAA
GGGTTGGTGAGGACTG 713. chr3_ECE2_NM_014693_-1.58101
TACAGAGGCCTGCATTCGAGTGGCTGGAAAAATCCTGGAGTCCCTGGACC
GAGGGGTGAGCCCCTGTGAGGACTTTTACCAGTTCTCCTGTGGGGGCTGG
ATTCGGAGGAACCCCCTGCCCGATGGGCGTTCTCGCTGGAACACCTTCAA
CAGCCTCTGGGACCAAAACCAGGCCATACTGA 714. chr3_CLCN2_NM_004366_-1.66957
TTCCAGACTGCCAAGACCCGGAAGATGAAGGCACTGAAGGTGGCAGCGAA
GAAGCCCCGCCAGTAGTTCCGCACTGCAAAGAAG 715. chr3_SENP2_NM_021627_-2.95524
GCAAGGGTCTGAGGCGTCCCCATTG 716. chr3_RTP1_NM_153708_1.52982
ACCGCGGAGAGTTCTGCGAGGCCTGCCAGGAGGGCATCGTGCACTGGAAG
CCCAGCGAGAAGCTGCTGGAGGAGGAGGCGACCACCTACACCTTCTCCCG
GGCGCCCAGCCCCACCAAGTCGCAGGACCAGACGGGCTCAGGCTGGAACT
TCTGCTCTATCCCCTGGTGCTTGTTTTGGGCCACGGTCCTGCTGCTGATC

Figure 3-60

ATCTACCTGCAGTTCTCTTTCCGTAGCTCCGTA 717. chr3_MASP1_NM_001879_-1.51342
CTTTCTTCTTCAGCGGGGCATAAGCCTTCTGGCAGGTGCTGTGGTCAACA
ATCGGGATTTCA 718. chr3_BCL6_NM_001706_1.58506
AAACTTCCGGCAAGTGTCCACAACATGCTCCATCTGCAGGTACATAGCCG
TGGCCATCACAGCCATGATGTTGCCCTCCCGCAAATTGAGCCGAGATGTG
TA 719. chr3_LEPREL1_NM_018192_1.54456
TGAGAGGCGGAGGCCGTGCCTGGC 720. chr3_CLDN1_NM_021101_-1.65806
AAGGCACGGGTTGCTTGCAATGTGC 721. chr3_ATP13A4_NM_032279_1.54701
AGGTAGAGCCGGAGGAACCGCAATTGTGATGACGTCAAGGGCTTTCCTCA
CCAC 722. chr3_HES1_NM_005524_-1.56921
AATTCCTCGTCCCCGGTGGCTGCTACCCCAG 723. chr3_GP5_NM_004488_-1.58257
GATTTCGGTGGAACTGCAGCTCCGTCAGGGCGCCCAGGCTGTTCAACAGC
CCCGAATCCAGAGACACAAGGCGGTTCGAGTGGAGCAGAAGTCTCTCGAG
CTTAGCCTGTGCTCCAAGCAACCCCTTGGGCAGGTGGGTCAGGTTGTTTC
CCGATAAATCCAACAACTTCAGGTTCTCCAGATTCGTGAAGAGACTGGCA
GGAAGGAAATCGAGCTGATTCTGGTTCAGAGCGAGCTCCTGCAGGTTAAC
CAGTTTCTGAAACATGTTTTGGTCAATGCCCCTTAGCGCATTGTGGTCCA
AAAACAACTGCTCCAGGAGCACCATCTTATCCAGCAGCGCACCTGGAAGA
TGCGTGATTTTGTTGCGCGACAGCCTCAGGGTTTTCAGTTTTATCAGGTC
ACTGAAGGTGCCGGGGGCAACGGCGGAAATGTGGCTGTCGGAGATCATGA
GGCGCTGCA 724. chr3_FAM43A_NM_153690_-1.8246
AGCGCAGCCGCAGCGCGCCCAAGCTTGGCTCCATCACCGAGGACCTGCTC
GGCGAACAGCTGGAGCAGGAGCTGCAGGAGGAAGAGGAAGAGGAGCAACC
CGAGGGCTGC 725. chr3_ACAP2_NM_012287_1.5409
GGCCGCGCTGGGACGCAGACGGCTACGGCGGGCGCACGGCCGCGACTAGC
GTTGCGCGGAGCTGCGAAGGGCGC 726. chr3_MUC20_NM_152673_-1.64391
AATGGAGGTTTCCTCCTCCTGCGGCTGAGTGTGGCTTCCCCGGAAGACCT
CACTGACC 727. chr3_MUC4_NM_018406_-1.77539
AATCGTAAGTCCCGTCGTCCCTGCTG 728. chr3_MUC4_NM_018406_-1.52305
CCCCACGCTAATCACCCTTTTCTCTCCTCAGCCCCACCCCACTACCCCAC
CAGGAAAGAAAACACCGATACACCCGTTGCTCTGCTTCTCATCAGCCTGA

Figure 3-61

GCTGAGTGGCGGGAGGGATGGGAGGAGACATGGGGGAATGGGAACAGGTC
ACACTGGAAATGGGTGGGCCACCCTCCTAGCCGGGTTCCTGGGTCCTCTC
CTCCCTCCCCAGGGGCTGCCCCTGTCCCACCAGAGCTTTGGGCTGCTGGG
AAGAATGGGGAAGAAAGGGCCCCAGAGGGAGCGACCTTGGGGCTGTA 729. chr3_TM4SF19_NM_138461_1.63302
GCTGTTGATGACATGAACGACCAC 730. chr3_WDR53_NM_182627_1.56799
GTCCACATGACACCAGGCTCTGAGGCCTCTGAGGCCGAAAAGCCACTGAG
GAGCAGATATTGGAATGTCTCTTCAAGGATCTGATAACTTTCTTGTTTTC
CAAGTCTAGGATTTTGATTGCCCCAGAGTCGTCAGCAGAAGCCAGCAGGT
TTTCCGTTTGATTCAATGAAAGACAATTGATTTCTTCTTCATTCACATGA
AAATGGTCCAAGGAATCTTTGAGGGACCTGACATCCAGTACACTAATGGT
TTCTCCATGTGAGGCATAGAGCTTGGTGGGACAGGAGGGAGAAAATAAGA
CACTGGTAACATCATCAGCCCCTTGGAACCGCGTGTGTCCTAATGGAG 731. chr3_NCBP2_NM_007362_1.52302
CCTTAAAGCCTGCGTCCCAGTCTGTGCGAATGATTCGGTCATCCAGACGC
GTCCCATTTATGTACCGCATGGCGTTTTCCGCA 732. chr3_LOC152217_NR_024388_-1.74721
AACGTCTGTCAGAGTCGCGGCCTATCCGACGTGCGGCGCAGCTCACGGCC
TTCGCACTGCTGCAGGCCCAGCTGCGGGGCCAGGACGCGGCCCGCCGCCT
GCAGGACCTCGCGGCTGGGCCCGTGGGCTCCCTGTGCCGCCGCGCTGAGC
GATTTAGAGACGCC 733. chr4_PDE6B_NM_000283_-1.70857
GAGCCTGCTGACTGCGATGAGGACGAGCTGGGCGAAATCCTG 734. chr4_GAK_NM_005255_1.52773
GGTTGGTGAAGAGCCGCTCTGTCCCACCCCGCAGAATGTCCAGGAAGCCG
CCATACGGCTGGTCGTACTCCGCCAGCG 735. chr4_DGKQ_NM_001347_1.60531
CGCCGGCCAGCACGTCAGAGGAGCCGCACGTCTTCCTGCAGAC 736. chr4_IDUA_NM_000203_1.74924
GGTCTACGTCACGCGCTACCTGGACAACGGGCTCTGCAGCCCCGACGGCG
AGTGGCGGCGCCTGGGCCGGCCCGTCTTCCCCACGGCAGAGCAGTTCCGG
CGCATGC 737. chr4_WHSC1_NM_133334_-1.66928
CTGGTCCGGCTGATGGGGGTTTGCTCAGCACTGTGCCA 738. chr4_WHSC2_NM_005663_-1.6484
CCCAGGGGTCCGAGTCGAGGCTGGCGAGCTGGAT 739. chr4_POLN_NM_181808_-1.85472
TGCTCCATAGACCACCGCGTACACCACCTTCTTGGTTTGCTCTCTGTCTG
CGTGTGTCACCTGTTCCACGGGCACATC 740. chr4_RNF4_NM_002938_-1.51516
CCGGCGGTGGCGCCTGCGGACCTAACTAG

Figure 3-62

741. chr4_TNIP2_NM_024309_-1.87732
CGTCCACTAGGGACGGCGCGGCGTCCCCCTCCAGCGCGGCCAGGCGGGCG
CGGAGGCGAGCGATGAGGGCGTCGCGGGCAGCGAGCTGGTCCTGCAGGCG
GCGCAGCCGCTGTCCGGCCTCGTGGTACAGGGTGCAGAGCGCGGCAGCTG
C 742. chr4_MFSD10_NM_001120_1.64038
TCCACTGGCATCCCGATGGCGGTGGCAAACCAGTCC 743. chr4_NOP14_NM_003703_-1.63088
CCTGAGGGCCCGTGCGCGAGACACCCCGGGCAGTCCCACGTCGTGGCGCG
TCTTCCGGCCCAGGATCTGGAACTTCTGCCTGTTAACTTTCAC 744. chr4_HTT_NM_002111_-1.67491
TTCTCTCACCTGCTGAAGGTGATTAACATTTGTGCCCACGTCCTGGATGA
CGTGGCTCCTGGACCCGCAATAAAG 745. chr4_RGS12_NM_198229_-1.83802
GGGACCCATGGCAGCCGAGACCTCCCAGTCAACAGAATCATCGATGTGGA
TCTTGTAACTGGCTCGGCGCCCG 746. chr4_DOK7_NM_173660_-1.58568
GTCACTTGGACGTCAGCGCCAGCAGCCGGCTCACCGCATGGCCAGAGCAA
TCCTCGTCGTCAGCCAGCACGTCACAGGAGGGGCCTAGACCAGCAGCTGC
CCAGGCCGCCGGGGAAGCCATGGTGGGTGCCTCAAGGCCACCCCCCAAGC
CGCTGCGTCCGCGGCAGCTGCAGGAGGTTGGCCGCCAGAGCTCCTCGGAC
AGCGGCATCGCCACTGGCAGCCACTCCTCTTACTCCAGCAGCCTCTCGTC
CTACGCGGGCAGCAGCCTGGACGTGTGGCGGGCCACAGATGAACTGGGCT
CACTGCTCAGCCTGCCAGCAGCGGGGGCCCCCGAGCCCAGCCTGTGCACC
TGCCTGCCCGGGACAGTCGAGTACCAGGTGCCCACCTCCCTGCGGGCCCA
CTATGACACACCACGCAGCCTTTG 747. chr4_LYAR_NM_017816_-1.61555
TTCCGAGTGCCTCCGCTTCCTCTTCCCTGCGCCCACGTGTGCCTCTTCCT
CACTGGCGCTGTCCTTGCGCTGCTTCTTCTTCTTGCTCCTCTTCCCTGCA
GAGCCATTGGCCTCAGGGACTTCCTCCCCACCAGCCTCAAGGTCAGCCTC
CTGTCCCTTTTTGCGCTTCTTAGGCTTCTGATTCC 748. chr4_D4S234E_NM_014392_-1.67578
TCCTCACCTGCGTCGTCTTCCTGGTTGTCTACAAGGTGTACAAGTATGAC
CGCGCCTGCCCCGATGGGTTCGTCCTCAAG 749. chr4_CYTL1_NM_018659_1.54257
AATGAAAGAGTGGGTCCTGTCAGCACTACGTAAAATATATATCTTAAGAG
CATTAATTTCTTTTTAAATGAAAGACAGTGAAGAAAGTCTGTGTTAGAAA
AAGGCATAATAGAAGCTTGGTTAAATGTAAGCAGGTTTCTATCAAGAAAG
AATAAAAGTACCATTACTCCATTAAACCAGTAATAAAAACATACTATTGT
GCAAGTTCTCAAAATAGTTGTTCATAAAAGTGAAGCTTGTTAGTCCTTTT
CTTCTTTTTAGTGACCAAATCAACATGCTGTGTATCTAACCATCCTGGCA
AGACATGAGTCAAGGGAATGAGAAGCATGGTTGCTAACTCTATGCTCAAA
GGAGGT 750. chr4_MAN2B2_NM_015274_-1.51658
CCAACCTGATGCACAGCATCTGGGA

Figure 3-63

751. chr4_GRPEL1_NM_025196_-1.63813
TGTGCACAACAACCGGGGAGATGGC 752. chr4_ABLIM2_NM_001130083_1.80389
CTGGCTGCTTGTCGACACGCCGGATGCCAGATGGAG 753. chr4_ACOX3_NM_003501_-1.60488
TCGCCGTCGGCTCTGCCAATCGGTGAGTCC 754. chr4_ACOX3_NM_003501_1.53023
CAGGAGGAGCGATCACGTCTACCAGGGCAACTGCA 755. chr4_FBXL5_NM_012161_-1.51538
AGTGTGGGGCGGTGAAGACGTCCACTTCTTCAGGAA 756. chr4_TLR10_NM_030956_-1.9921
TTACCACTTATTTCCTCATATGAAT 757. chr4_TMEM156_NM_024943_1.59995
GTGTATATTGATCTCACTGATGCACTGTGGAAGTAAC 758. chr4_LOC401127_NR_026854_1.53595
CTCTGTCATCAGGACCCTCCGTCCACGTCCCCTGTGCGGCCAGCGTCAGA
G 759. chr4_RHOH_NM_004310_-1.69105
TGTTTGAGTGCGCCGTCCGAACTGCCGT 760. chr4_APBB2_NM_004307_-1.51123
AAAGGTTGCTTGTGACAGGTCCAGCCAAGAAGACAGTGAAACTAACTCAC
GCATCATTCATTCCAAGGACGCAGCGTTAGTTCACTAGGAGGGGTGGGGC
CACACTCTTCTCTGTGTGTGTGTGAAGTTAAGTAATGTTCACAATATTTA
CAATAAGAAAAAGACCTTCCACTGCGCATGATGTAACTTACAGCAAAAAA
AATTATTCATGCTTCTTTTCATATCACATGATGGTGGCAAGACGAGAGAA
CATGCTTGTCTAACACTGCTTGGTTAAGGGTAAATTCTCTGAAGACAAAG
CATCAGCAACTGGATGGAAGGTCGGATGGCGGAGTTCATTTTCTTTAGTG
TAGCTAGTCAATCTTCAGGTAAATAGCCGAGTCCTTTTGCATGTGCAG 761. chr4_LIMCH1_NM_014988_1.68458
TGGGATTCCGAGCGCAGCGACTCCCTCTCTCCTCCTCGCCACGGCAGAGA
TGATTCCTTCGACAGCCTGGATTCCTTTGGCTCTCGCTCTCGGCAGACGC
CTTCACCAGATGTAGTC 762. chr4_GABRA4_NM_000809_-1.93464
AACAGGTCCAAAGCTGGTGACATA 763. chr4_GABRA4_NM_000809_1.6815
GGAAGCGCAGGAGGGCGAAACTGACCCCGGCGGACAGAGCGATCGCGGGT
A 764. chr4_TXK_NM_003328_1.88144
GGCTTTCGTTTTGACGGCTGCACACGGCCCGTGTT 765. chr4_KDR_NM_002253_-1.6859
TTCCTCACTGGAGTACACGGTGGTGTCTGTGTCATCGGAGTGATATCCGG

Figure 3-64

ACTGGTAGCCGCTTGTCTGGTTTGAGCCTTCA 766. chr4_SRD5A3_NM_024592_-1.59461
AGTAGATGAGACTTCTCCAAGCTGCTTCACAAGCAAACTAACCGAAAAAC
CGAAAATATACAAACAGCTTCACACACACACACACACACACACACACACA
CACACACACACAAAGGAAGATCATCAATGGCTGCGGTAGCCTAGTAGGAA
TGGACTATATAAT 767. chr4_HOPX_NM_001145460_-1.59536
GCGGCAGTAGAGAAAAGTAATCGAAAGCCAAGCACGGCAGACTATCATGG
GGGTAGCCTTCTCTTTGGGGGCTACTTTCTGGGTGCCATATTT 768. chr4_HOPX_NM_032495_1.53803
CACTGAAAGTATGCCGAGGTTACGTCTCTCCTGGTTATTCAGGTTTGATG
TTCAGGCTGGGACTTCTGAGAGTCTCATGGAACTTTCTCGTCACTATCTT
CTCGTCCCTGACCTCTCTCCTAGCCAAGCAAGCTTCTTCACCAAGATAGG
ATAAGAGAGATGTGGCTGAGAGAAGACGGGGAAGAGAAAAGGGACCCTGA
GTCTTCTCA 769. chr4_LPHN3_NM_015236_1.81509
TCCAGACCCGTGTCCAGGAACCTATAAATACCTTGA 770. chr4_TMPRSS11B_NM_182502_1.51696
AGAGGCTCCACAGTAGTGACGGCCTTTCCATTGCATGCTGGCCTGCCATG
GCCATGCCCCCTCCAGGGAGCTTTTTCCATTCACAATTTTGTTGCCAGTT
ATGATACTGTTGGCTACTTGTCTCCCA 771. chr4_CXCL5_NM_002994_-1.509
GCTAGGGCCTCGAGGATGTCGCTATATATTTTTATAACTAAATGATAAAT
TTATATTCAAATTGTTTGAATACGTTTCCAAAACTTTCAGAGTACAAGTC
ATTGTTAAGTTTGCCTTTACTTTAAAAACTAAAAGAATACATTTCTATAT
AAACTAGCAGTCAGGAATTTGCCTGTTTTCTAGCTTCTTCATCTATCTAA
AATATATATTTAGCTACCAGAATTATGGTACTCCTAATAAAATACTTAAT
AAATAGCATATAAAATCAAAGTTTAAAAGTAAATGATGGCAGTTTGCCAT
ACTAAAAAGATAAAGAATGTCTAAAATTATAGGAAGATAAGATATTAGCC
CTCATAGAACTTAAACTTTTAGAAATTCTGAATAAGGAAATATATTCTAC
ATAGATAAGGTGTGAAACACTCAGCTTTCTAAAGTGAAATAATTAAATAG
TATCCCACAATCAAGAGTAAGGAAATTCTCTAACATATTCCCCAAGAAAC
ATTAAAATATTTCCTATTTCTTATAAAAGTGAAGATAACAGTGTATTTCC
ATCAACAGAATTCTTATGAAACATCATTTCCACATTAAATCCACAGCCTT
CTCAGTTAATATCTTAAGGAATATTTCTTGGAAATATAATAGTCACCTAC
AATTCAAGACACTTTGAAAGATTAACAGCCAGTGATTCCTGGCTCACACT
ATAGTCAATTGCCAAAACTTCAATAGCATAGCAGATAAAATAACAGCAAA
TAGCAGAGGTACTATGCTAAACACTTCATTAGCTGAGCTGAAAGCTTAAG
CGGCAAACATAGGTTTTCCTCACACTCTTCAAAGTGAGGAATCCAGGAAG
AAAGCTAACTACTGGAAAAACAAATAAACAAACAACAACAAAATCTTTCC
TTCTTGTCTTCCCTGGGTTCAGAGACCTCCAGAAAACTTCTCTGCTGAAG
ACTGGGAAACTTTTCCATGCGTGCTCAT 772. chr4_ART3_NM_001130016_-2.84552
TGTGAAAATCCTTGAACCCACCCAAATACCTG 773. chr4_PRKG2_NM_006259_1.67395
ACTCCCTTGCTGATAGTTTCTCCCATACATGCATTCCACCATGTCTTTGA
TCTGCTGAGGATCCAGTCTTTTCAGAAACTGATTTTTATTAAGGGCATCT

Figure 3-65

GT 774. chr4_HNRPDL_NM_031372_1.93741
TTCGACCAAACTCATACCTTTCTACCAAAATCCTTGAG 775. chr4_HPSE_NM_006665_-1.74998
ATTCCAACCGTAACTTCTCCTCCACATCAGGAGGGATGGATCCATATTTG
CAAAT 776. chr4_HPSE_NM_006665_-1.68768
GGAGGATGAGGAACCGCGGGTCCGTGGCCAGGTTGGCGTCAATGGTGACG
GACAGGAACGA 777. chr4_FAM175A_NM_139076_-1.71858
GTCCGAGTCCGTGTTGAGGTGCTGGAAAGCGAGTGCGCCGAGCACAAAGC
CCGAGAGCACCGCCGACGTA 778. chr4_WDFY3_NM_014991_-1.99942
TCCGCAGGGGAAACAAAACTGCACA 779. chr4_MMRN1_NM_007351_-1.88325
TTGATACACACCAACCAGGCTGAAAGT 780. chr4_ADH1B_NM_000668_-1.93148
CACCAGCAGACTGTGAGTCTTTGTG 781. chr4_MAPKSP1_NM_021970_1.55121
GAACCCCCTTCTCTCGCAGGATCAATCTCC 782. chr4_H2AFZ_NM_002106_1.57595
GATTTTAGGTGTCGATGAATACGGC 783. chr4_MANBA_NM_005908_1.64682
GCCAATAAAGTGCCCCCATCGTGTGCCCTTGCTGATCCACTATCTCGCTG
CGACTACGGCGGTAGAATTCAGTTTCTGTTTTGACACACTGGGCC 784. chr4_LEF1_NM_016269_-1.62267
CCGGGATGATTTCAGACTCGTTCACCAAGGAAGACTTGATGTCAGCTAAA
TCGCCTTCCTCTTCGGGATGACTGATCTCGGCGAAGATCTTTTCCTTCTG
AG 785. chr4_COL25A1_NM_198721_1.80687
AGTCTTGAGGTGATCCAGGGTATCAGGCAGCAGATGAATGGAAGGGGCCC
CTTTGGCGGATTCGAGAGCGGCGATCCTCGCCTGGAGGTCGTTGGTTTTC
ACACCCAGGTACAGGCAAGACACCACGGCCACCACTGACAGGAGGGCCGC
CAGGACGGCACACGGGGGCATGGTCCGGGCACAATGCTGTTCG 786. chr4_CFI_NM_000204_-1.89773
TAAAAATATCCAGTGAGATTTGCT 787. chr4_LRIT3_NM_198506_1.52982
AGGTTCCAGACCAGAGTATTATTGCTAA 788. chr4_ENPEP_NM_001977_-1.63448
TTCGACTGCCGGACTTCGTCAACCCAGTCCACTACGACCTGCACGTGAAG

Figure 3-66

CCCCTGTTGGAGGAGGACACCTACACGGGCACCGTGAGCATCTCCATCAA
CCTGAGCGCTCCCACCCGGTACCTGTGGCTGCACCTCCGGGAGACCAGGA
TCACCCGGCTCCCGGAGCTGAAGAGGCCCTCTGGGGACCAGGTGCAAGTC
CGGAGGTGTTTCGAGTACAAAAAGCAGGAGTACGTGGTGGTCGAGGCGGA
GGAAGAGCTTACCCCCAGCAGTGGAGATGGCCTGTATCTCCTGACCATGG
AGTTCGCCGGCTGGCTGAACGGCTCCCTCGTGGGATTTTATAGAACCACC
TACACGGAGAACGGA 789. chr4_PITX2_NM_000325_-2.11604
AGTCCTTGGCTACTGCCCCGCCGAGCCCCCGTAGCCGCCGCTGCCCGCTC
CGGGTCGCGCTCTAGGCGCGGAGTTTCC 790. chr4_EXOSC9_NM_001034194_-1.64966
TTTGGCAAATACGTGTAGACCTACATTTATTAAATCATGATGGAAATATT
ATTGATGCTGCCAGCATTGCTGCAATCGTGGCCTTATGTCATTTCCGAAG
ACCTGATGTCTC 791. chr4_TRPC3_NM_001130698_1.56947
CGTTGCTGAGCTCTAGGGCCGTAAGCACCGGGTCCTCGCTGGACAATGAG
AGGTAAGCCGGGCTGGCCAGCCCCTTGTAGGCATTGATCCTCGAGCGTGA
GTGGCTGAAGGAGTCGTGCCTCTGCTTCTCCATGCAGTCCCCGCACTTGC
AGAAATAGTCGTGCGGCCGCTCGATCCTGGCACCCTTCATCAGCAGCATG
TGCACCACTTCGTATTTCTGGCAGTGCGCCGCCAGGATGATGGGGGTGAT
GTCCGGCGAGAAGCGCGTGCCGTCCTCGTCGTAAGCGTAGAAGTCGTCGT
CCTGCAGCTCCTGCTCACAGGGGCTCAGAGTGAGACGCTTGCTGGCCGCG
AAGCCAGGGTGGTTGAGGATGGCCTCTACGATGCGCACGTAGCCCTTGCT
GATGGCGAGCAGCAGGGCGTCGCCAATGCGCGCCAGGTTCTCCTTCTTGA
GCAGCAGCTCGGTCACCTCCAGGTGCTCGTTGCCCACAGCCAGCTGCAGC
GCGTTCTGGCCCATGTAGTCCACGCAGTTGACGTTCAGCG 792. chr4_MGST2_NM_002413_1.68029
TTTTGCTACTTGTCTGGGTCTGGTG 793. chr4_SCOC_NM_001153484_1.79071
GTTGGAACTCCAACACACACTTGA 794. chr4_UCP1_NM_021833_1.60059
CCTGGACCGTGTCGTAGAGGCCGATCCTGAGAGAGGCGGAGCTGATTTGC
CGCTGAAGCCCCGCAGGCAGCCCGCTGTAGAGTTTCATCCGCCCTTCTGT
TTTTACCACAGCGGTGATTGTTCCCAGGACACCTTTATACCTAATAACAC
TGGACGTCGGGCATTCACCTTGGAC 795. chr4_UCP1_NM_021833_2.10941
GGAGCCGGACTTTGGCCGTGTCCAGCGGGAAGGTGATCACGTCCGCCAAG
CACGCCGCTATTCCAGCTGAGAAGAGCTGGACCCCCAGGGTCGGGTGTAC
GTCCGAGGCTGTCAGGC 796. chr4_NR3C2_NM_000901_-1.629
GGTCCGTCTCTCGCCGTCTACCTGTTGCAGCGCTTGCCACCGCCACGAAA
CCCCTGCTGCGGAGCCCCCCTAAATCCAACCACATCCAGGCCAGCGAGTG
CCGCTCTC 797. chr4_TMEM154_NM_152680_2.044
CGACGGGAACGAGCGCGATCACCAGGGCGAAGACTAGGGCTGC

Figure 3-67

798. chr4_TRIM2_NM_015271_-1.64877
GGCCAGTTCAAAAGTCGTTTTGGCATACGGGGACGCTCTCCGGGGCAGC 799. chr4_DCHS2_NM_001142552_-1.74539
ACCGCTTTCGGAATCAATGGCAAAAGATGGTCCACACTCTGCGGTGTGGA
CCATCTTTGATTGCAGGGAGCCGAGATTGCAGGGAGCCGAGAGTTGGACT
ACAGTGTAGCGCAGCCAGGCGTGATCACTGCCTGCCTCGTCGGCATCGGA
GGCGCTGACCCACATGACTACAGTGCCAGGGGCCGCGGCCTCGGACACTG
AGGCCTTGTAATGCTGTTGGCTGAAGAGAGGTGGTTGGTCATTGAGGTCA
GCGACCCGGAGTAGCAGCGTCTCCTCCGTGCTCAGCGGCGGGGACCCCGC
GTCCGTGGCCACCAGTAGTAACTCATACAGATCGCGGCTCTCTCTGTCCA
GGGGCCCCTCCACGCAAAGGAAAAATACCCCTGGGGGGCCGCCGGGTAGC
AACGCGAAGTCTCCCTCTCCGCCTTCCAAGGACAGAGAGATGCTCCCGTC
TCCAAGACCCACACCAAGCTCCCCTGTGGCCTCATCTTCCTTCTCCCAGT
CACCGTCCGCGTCAGACACCGAGACGCGAGCCACGTAGTCGCCCCGGTCGG
GCGCCTTCAGAGACACGGGCGACGCCTCCCTCTGTGAGAAAGAGCACGTG
AATTGCTGGCCGGTTGTCATTCACGTCCAGCACGGCGATGGACACGCGCA
CCGTGGCAACCTCAGGCTCGGCGCCTCCATCGCGGGCCTCCACCACCAAC
TGGTGCCAGGCCTGTGCCTCGCGGTCCAGAGGTCTCCACACTCGCACCAC
GCCGCTCAGCTCCTCCACCGCGAAGTAGGCCGCGTCGCCCAGTGCCCCGC
CGCCGCTACCCGCCCCAGGCACTTGCCGGGCGCGGACGCTGTAGCGCACG
AAGCCATTGGGCCCCAGGTCGCGGTCGGTGGCGCGCACGCGACAGACCTC
GGCGCCCGGCTGGGCGTCCTCGCGCACCGCGGCGCGGTACTCGTCCTGCT
CAAAGACCGGCGGGTTG 800. chr4_RAPGEF2_NM_014247_1.7067
GAAAGGAGGGCAGGTATCGAGAGCCCCCGCCCACCCCTCCCGGCTACATT
GGAATTCCCATTACTGACTTTCCAG 801. chr4_TLL1_NM_012464_-1.69221
GCGGCTCGCGCTCGGCCGCGGAGTCCTGGCAG 802. chr4_TLL1_NM_012464_-1.88988
AGAGACGGGTACTGGAGAAAATCA 803. chr4_PALLD_NM_001166108_-1.66196
AGTTCAACAGATTCTGACAGTGAA 804. chr4_HMGB2_NM_002129_-1.67567
TTCTGGTTCGTTCTTCTTCTTTGAGCCTGTTGGCCTGCCAGGGCCCTT 805. chr4_VEGFC_NM_005429_-1.88934
GTCTTGCTGAGGTAGCTCGTGCTGGTGTTCATGCACTGC 806. chr4_VEGFC_NM_005429_1.76825
TCCCGTGGCATGCATTGAGTCTTTCTCCACT 807. chr4_PDLIM3_NM_014476_-1.63566
GAAAGGTTTGGGCCGAATATTATGCTTGTGTTCAA 808. chr4_SORBS2_NM_001145671_-2.02377
TACCAGTGACTTCTCCGAGTCGGGAGCTAGAAAGAGGCTTCCGGCCAGGT
TCCCTTGGAACAGGTG 809. chr4_FAT1_NM_005245_-1.71778

Figure 3-68

CCCGAGCAGGGACCGGGCCTGCCGGG 810. chr5_FLJ44896_AK126844_1.74085
CAGCAAACATCCAGGCGGCGGCAGCAGCTCTCAAGGTACACTTGTCCTGT
GAGCCGCAGAG 811. chr5_PDCD6_AK295082_-1.51523
ACCTGGGCTGCTTTGTATCCGACCCGCTTGGGTACCCGCTTGTGTTTCCT
TTGTCTGTGGGTCCGTATCACTTTGCTCCCTTCTGGAATTCCACTTAGAT
GAGCGTCGGCCCTTTCATCCCTCTCCCTCCGTCTCTGTACCTTTTCACAT
CTCTCCGTGTATGTTTGCTCTATTC 812. chr5_AHRR_NM_020731_-1.57705
AGATGATGCTATCCTGGGGAGGCTGCT 813. chr5_EXOC3_NM_007277_-1.55276
GTGGATGTCGGCACCCTGGAGCCATTGCTTTCTCCACACGTGGTCTCTGA
GCTGCTTGACACGTACATGTCCACGCTCACT 814. chr5_CEP72_NM_018140_1.51479
ACTTCAAACAAGTGTGAAGAGGCTGTGTGGCGAGATTGTGGAACTGAAGC
AGCACCTGGAGCACTACGACAAGATCCAGG 815. chr5_TPPP_NM_007030_1.64933
CTGCGTGCTTGTAGCCGGACACATAGCCTGACTCGTCCACCAGATCCACG
CGGCCAGCCTTGCCCTTGCCCTTGCCAGAGGGGTCGAAGCGCTCCTTGTG
GGAGCCCGTGAACTTGGTGGTGTCCGTGAGCCTCGACACTGTGGGCGACG
AGATG 816. chr5_NKD2_NM_033120_-1.5654
ACCATCTATGAGGTCGTGGATGCCTCGGTCAACCACTCCTCGGGCAGCAG
CAAGACCCTCCGTGTGAAGCTAACCGTCAGCCCTGA 817. chr5_CLPTM1L_NM_030782_1.61338
CCAGGGCAGATGTGCCACTGACTTCAA 818. chr5_SLC6A3_NM_001044_1.56041
GCCTGGGCTTTGCACGCGAGTCCTGGCGCCGAGAGCGTTCCGCGAAGCCT 819. chr5_NDUFS6_NM_004553_1.62612
GAAACAAAAACCGGCACATGCGGTTACTGT 820. chr5_NSUN2_NM_017755_-1.50117
TCCTGAGATAATGAAGCCGTTCATTCTTGGGCACAAAAGTTCGAATGGAG
GCCTTTCCCCGCCATCCGCATAAGACGATGGGACACTGCAGAGCGTCTGG
ATTC 821. chr5_ADCY2_NM_020546_2.08882
CAAGCCCTTTGCACACCTACATCACAGGGACAGCATGACCACAGAGAACG
GCAAGATCAGCACCACG 822. chr5_SEMA5A_NM_003966_1.69989
GTGGATGACAGTCGCATCGTGGGATTGCTGCTGGTACCGCTGGCAGTAAG
TATAGACGAGCAGGGTGAGGAGGCAGCCGAGGATGGAGCTGCTCAGCCCC
ACGGCGATCATGTGGAACATGT

Figure 3-69

823. chr5_CDH18_NM_004934_1.59702
AGATCTGTAACTGGCTCCCTGTTTC 824. chr5_RNASEN_NM_013235_-1.51325
TTTGACTTTGGGACTATTTGCTAGGAGGTGGCGAAGTTTCACATAACTCT
TCCACAGTTT 825. chr5_DNAJC21_NM_194283_-2.79749
GGAGTTTGGAGATGGATCGGATGA 826. chr5_DNAJC21_NM_194283_1.54368
TAAAGACAGTGATGAGGCCGAGGACGCTGAGCTCTATGATGACCTTTACT
GCCCAGCATGTGACAAATCGTTCAAGACAGA 827. chr5_PRLR_NM_000949_2.5952
CTTGGGCTTGCCGCTGTTCTCTCT 828. chr5_EGFLAM_NM_152403_-2.15216
TCCTTGGGCCTTCGGGATGGAGCCCT 829. chr5_SEPP1_NM_005410_-1.94538
TCTCTGTTCCTCCCGATGGGAGGA 830. chr5_NNT_NM_012343_1.73877
TAGACATCCTTATCAGCACAGCACT 831. chr5_SNX18_NM_001102575_-1.71985
CCGGCCCGCTACGCCAATGTGCCCCCCGGGGGCTTCGAGCCCCTGCCTGT
CGCG 832. chr5_PDE4D_AY245867_-1.62764
CTCATGGGCAAGGTTCTAACACGCAGGAGCGCTTTCTTCCTTCATACTGA
ATTTACTCCAGTACTAGGCTGTTAGGAAGTGACAGTTTCTTCTGTGTCTT
GCAATGCCAAGGGAGGAACTGAATTCTGAATTGATTCTTCATCTGGGTCA
CAAGGGAAACCAGCATAGTGAAAGAGTCACTTGATCTCTTTTTTGCAATT
CCATAGTAACAGCTTTAAAGGTTTCTGACACTCGAAGAGCGCAGGTAGAG
AGAGAGAAAAAGAAAATGACCGGGAGGTACTGTAACACGGGAGAGCTGTC
AAGGAAGTTCCATTTCAGGGCAAGCACAGGAAAACACTCCTCTCCGTGGA
GCAAAGAAGTCAGCC 833. chr5_SFRS12_NM_001077199_-1.55515
TAGATCCCATAATAGATCACGTTCAAGACAGAAAGACAGACGTAGATCTA
AGAGCCCACATAAAAAACGCTCTAAATCAAGGGAGAGACGGAAGTCAAGG
AGTCGTTCGCATTCACG 834. chr5_MAST4_NM_198828_-1.88175
TTGACCACATATTATCCCCTCCACC 835. chr5_SLC30A5_NM_022902_1.58612
TGCCAATATCTTATCATCTCCCTCTAAG 836. chr5_BDP1_NM_018429_1.5504
ACTGAAAAGCCATCGACTCCAGTCCAGACAAGA

Figure 3-70

837. chr5_MCCC2_NM_022132_-1.7595
TGTGGGCCGTCCTGAGGTTAGCCCTGCGGCCGTGTGCCCGCGCCTCTCCC
GCCGGGCCGCGCGCCTATCACGGGGACTCGGTGGCCTCGCTGGGCACCCA
GCCGGACTTGGGCTCTG 838. chr5_PTCD2_NM_024754_-2.27983
TCAGCCGTCGCACCTTCCAGCCAC 839. chr5_POLK_BC050718_-1.69381
TTTTGATATGGTGTCCTTAGTTTTTA 840. chr5_IQGAP2_NM_006633_-1.76575
ATAATTGATGTGATCCGGAACCAGCCAGGGA 841. chr5_F2R_NM_001992_-2.23496
CAGAGACTCTCACTGCACGCCGGAGGGCGCCCTTCCTCGCTCGCGCCCGC
GCGACCGCGCGCCCCAGTCCCGCCCCGCCCCGCTAACCGCCCCAGACACA
GCGCTCGCCGAGGGTCGCTTGGACCCTGATCTTACCCGTGGGCACCCTGC
G 842. chr5_RASGRF2_NM_006909_1.67061
CGTGCCAACGCCATCGAGAAATGGGTGGCAGTGGCGGACATCTGCCGATG
CCTGCACAACTACAACGGCGTGCTGGAGATCACCTCGGCCTTAAACA 843. chr5_ZCCHC9_NM_032280_-1.86918
GCGAATGGTCACAGTTGGTCGCTGGGCAAAG 844. chr5_RASA1_NM_002890_-1.55375
GGACGAAGGTGACTCTCTGGATGGACCAGAATACGAGGAGGAAGAGGTGG
CCATACCGTTGACCGCTCCTCCAACTAACCA 845. chr5_POU5F2_NM_153216_-1.79093
GGCTACCCCTGCAGAGTAGAGACGTGTATAGTGGGGGATATCCACTGGGA
GCCCCAGTCCCAGGTGAAAGCACA 846. chr5_GPR150_NM_199243_2.18525
GCCGCCAACGTCCCTGCAGCCAGGCGCGCCCCCGGCCGCCCGCGCCTGGC
CGGGGGAGCGTCGCTGCCACGGGATCTTCGCGCCCCTGCCG 847. chr5_SLCO4C1_NM_180991_-1.53661
ACAGTTATAGGAGTACCGGCCATAAAGGTAAAAATAATTACAATAAAGAA
AATGCAAAGGAATATGGGCAGTTTCGCACAATGAGTTTCACATTTTCCAG
CTTTAGCTTCAAAACCAAAAGTTTCTGCAGTGGATGTTATT 848. chr5_GIN1_NM_017676_-1.54891
ATTCTCTTATGTAGGGCTTAAGGTGGGACATTTTGATAGGT 849. chr5_FBXL17_NM_001163315_1.54394
GAGCATGCAGGGCCCGCGGAAGAAGCAGTCCCGGCTCCG 850. chr5_PJA2_NM_014819_-1.57018
ACTGTCATTTGAAGGTGGGGCATCAGGATCAGGCTCAGAGGAAGGAGCTG
CAGATGCTTCAATAACCGCAGGTGGGAAATGACGGCGGCACACAGGGCAT
G

Figure 3-71

851. chr5_EPB41L4A_NM_022140_-1.56167
TAAGGGTTAACTTGGATTCATCCAGGAGCAAAACTTCGCAGTAAAATTCT
TCCGGAACAGCGCAGAAACAGCCCAT 852. chr5_EPB41L4A_NM_022140_1.58578
CGGTTGTGGTCGTCTCCAGCCAGGAGAGAAAGCTACCACCGAGGCGCCCA
GCCGCCCCCTCCACTCAAGCGCGATGCATTAATTTATTGTCCGCGCCGTG
GCG 853. chr5_DMXL1_NM_005509_-1.50023
TATATCCTGCATGCAGTGCTCCTTA 854. chr5_PRR16_NM_016644_-1.50909
GACTGACAGCTCCAAAACGGACACGCTGAATAGTAGCTCAAGTGGCACAA
CAGCCTCCAGCCTAGAGAAGATCAA 855. chr5_SNCAIP_NM_005460_1.59747
ATGGTCAGTTGGAGTGCGTACGCTGGATGGTGAGCGAAACAGAAGCCATT
GCAGAACTGAGTTGTTCTA 856. chr5_ALDH7A1_NM_001182_1.55599
CGTTGTTAGCAGGGCAATAGGTCGTAATAAC 857. chr5_MEGF10_NM_032446_-1.52007
GAACTTGCAGAACTCCCTCGGAGACGCAGGTTGCAGTGGACATTGGGATT
GTTGCTTGAAAAATTAAAATTTGAATATTTTCTCTCTCATTTGCATCATA
CAGCTCTACCTAGGATTGTACAGTTTACCATAAAATTTACTTCATGAAAG
TGGGAATCACTGAACATGTAGAAGACAAGGAACATATTGTTAACTCCTGA
TTCTTAACTTTATTCAACTGGACTCAGAATTGTAGGGATAATATGAATGC
AGGAGGAAACATTCTGTCAGGCGGTATGACTGGACAGACTTTGAATATAC
TCTAAAAGTGGACAGAAAATTTACGAAAATCTTAGATTTTGTTTAGAATG
AGAAAATATACAATTAGAATTATTTTAGAAATAGTAGGAAGTATTGCAGA
AGTCAATACACAAATGTGCCAGGCAGAGGTGGTTTTCTCTGTTTGACTCT
CAACCAACTTCAGATCTATGACATTATTCTGATCACTGGCTCCATCATAC
ATATTCACCACTTGAGATTCATAACATATCAATAGTTATTTCATAAATAT
AGAAATGAAATAATTTTATTTTTGACAGACTGGATGGAATGAGTGTGTAA
TGATTGATAAAGGTTGTAAATTTTAAATGCAAGATGACGCTTACGTTCTG
TAAACCATTAGTAATACATGCTGTAATATAGAATTAGTGGAACATTTTGA
TTAATCTTTCCCTAGAAGTGACTGAAATATTTTTGTGCATATTTGAGAAA
GGGAACTTTCCTTTTATTAATTGTCAATTTAGAGAAACTATGCTTAAGCT
GGTCTTTTGCATTGCTAATGTGACATGTACCCAACTTTTCATTAATTTGT
ATTTCCATTTTTAAATTGCATATTCTATGTTTTGTAGTGTTTGGATTGTT
AATGAAAAAATATTATATGTTCGTTATTCCTTGTATTATTGCCACTTATC
TTTTGCTTGATAAAAATGCGTTGTTCTTTTTTCTTTTGGAGGGACAAGAT
GAAAATATATAATTTGAATTGATTAAAATTGGTCGTTACTAAAATAGTAT
AGTAACCACAAGTGATTGGCTTATAAATGAAGTAGAAATGCTTTTTAATA
TTCCAAAATAGAGTTCCTTTTGATCTGTTGGTGCTGAGCCTTGGTTAAAC
CAGGGAGAAGGGGAGCAGAAAGGAAACGTTGTTACTGATGAGTACCACAG
ACTCATCTTAAAAAAAACTCTCATTATGGTGATCATAGAATTGACCATCC
AAACTGGGACACTCTTGAGAGTAAATGGAGGGCATTATTAATAATTATCT
TGTAATGAACTTAAATCTGGACTGTTCCAGGCAAACCAGACTTATCTTGC
AATATGAGAATGCTGACACAATGCAGGAAAGCCAGTTTCCCTTTTGTTGA
TCTACTTGACCAAGCAAAGGGGCTGAAAAACTGAATAAGGAAACAACTTT
ATAAGAGAAACAGTGGTCTTCAATCTTTTAAAGACATGAAATCCTATATG
GCATTCTGTCTCAGTGAGTCAGTTAACAAATACGTATGTGCAACCCTTCT

Figure 3-72

GCTAGTAGTGCACATAAGTGATTATCCCTGCCAGGTATCGAGTTGGAATA
TCCAGTTATTTCATGTCACACATCGGCACGTATGATGGTGGTTTGGTCAG
ATGGATAATACAGCAGACACACTTAGAACACTCACTGCACTGGTGGCTGT
TCATTTTGAGGAACTCCAAAGTCAATTCAAGGAAATAAGGAATGACCTGG
AACAGGCCTTAGAAACAATTGATTTATTCCAATAGTTAACCACTGGCTGG
CTCCCAACTCTAGGTGATAGGCATCTAATTGAGACATGTGTGAGTCAATA
GCCATCGGGGTCCTT 858. chr5_ISOC1_NM_016048_-1.56305
TTCGCGCGACCCTCGTCGGTGCCACACGGGGCGGGCTACGAGCTGCTCAT
CCAGAAGTTCCTCAGCCTGTACGGCGACCAGATCGAC 859. chr5_ISOC1_NM_016048_1.59153
TGCATCCAACAAACTGCCCTGGAGCTAGTTGGCCGAGGAGTCGAGGTTCA
CATTGTTGCTGATGCCACCTCATCAAGAAGCATGATGGACAGGATGTTTG
CCC 860. chr5_ADAMTS19_NM_133638_1.7216
TGCCGAGCCGGATGGCGACGAAGTGTTGCTGCGGATCCCGGCCTTCTCTC
GGGACCTGTACCTGCTGCTCCGGAGAGACGGCCGCTTCCT 861. chr5_ACSL6_NM_015256_1.60918
AAGCCTGAGAAATCAGCCACCACGTTCCCATGGGTGAGCATCGCACCTTT
TGGGTTCC 862. chr5_PDLIM4_NM_003687_-1.66894
GGTTACTTCTTTCTGGACGAGCGGCTCTACTGTGAGAGCCACGCCAAGGC
GCGCGTGAAGCCGCCCGAGGGCTACGACGT 863. chr5_RAD50_NM_005732_1.51955
TTCAGGGTTCAGCAGTACAGCCGAGACTCGACTCTGTGCCTCCCTCCCCA
GTGCAAATGCATGCTTCTTCTCAAAGCACTGTTGAGAAGGAGATAATTAC
TGCCTTGAAAATTTATGGTTTTGGTATTTTTTTAAATCATAGTTAAATGT
TACCTCTGAATTTACTTCCTTGCATGTGGTTTGAAAAACTGAGTATTAAT
ATCTGAGGATGACCAGAAATGGTGAGATGTATGTTTGGCTCTGCTTTTAA
CTTTATAAATCCAGTGACCTCTCTCTCTGGGACTTGGTTTCCCCAACTAA
AATTTGAAGTAGTTGAATGGGGTCTCAAAGTTTGACAGGAACCTTAAGTA
ATCATCTAAGTCAGTACCCACCACCTTCTTCTCCTACATATCCCTTCCAG
ATGGTCATCCAGACTCAGAGCTCTCTCTACAGAGAGGAAATTCTCCACTG
TGCACACCCACCTTTGGAAAGCTCTGACCACTTGAGGCCTGATCTGCCCA
TCGTGAAGAAGCCTGTAACACTCCTCTGCGTCTATCCTGTGTAGCATACT
GGCTTCACCATCAATCCTGATTCCTCTCTAAGTGGGCATTGCCATG 864. chr5_AFF4_NM_014423_1.55307
TCTGAGCCTCTCTCGTGTGCTTTTCTGGCACATTTTTCTTTTCCCCCTTG
GGCGGCTCTGTTTCTTTGTAAGGCTTTCCTGGTATTCTAGTCAAAAGATT
CAGGTCAATCT 865. chr5_ZCCHC10_NM_017665_2.68571
CTTGGCCTTTCTTTCTACATTGGTT 866. chr5_C5orf15_NM_020199_1.91736
AAATATGTGAGTTGAGTACGGTTGGGCTCGGTGAAT 867. chr5_SAR1B_NM_001033503_1.79194

Figure 3-73

ACATTAGAGTTTGTTTTATTGCAT 868. chr5_TGFBI_NM_000358_-1.62816
CAGCGGGGACATGCTCACTATCAACGGGAAGGCGATCATCTCCAATAAAG
ACATCCTAGCCACCAACGGGGTGATCCACTACATTGATGA 869. chr5_FAM13B_NM_016603_-1.58079
CCTTCTATGATTGGCTGTAACATCTGACCCCTTCGCTTGGTGGATGGAGA
TC 870. chr5_FAM13B_NM_016603_-1.60893
AAGAATAAGTTCAAGGGTTGCTTC 871. chr5_REEP2_ENST00000254901_-1.53101
CTGGGCTGGACTCCCGTGCTCCTCAGG 872. chr5_ETF1_NM_004730_-1.61858
TGCTACTTTCCGAACATAGTTATGTCGCTTTTCCATTCTTAA 873. chr5_ETF1_NM_004730_-1.62628
GGACTGAAAGGCGGTTTACTCGTGACTTAATG 874. chr5_CTNNA1_NM_001903_-1.68488
GGGAGACAAAGCAGCGCCCGTCTGCTTCGGGCCTCTGGAATTTAGCGCTC
GCCCAGCTAGCC 875. chr5_CTNNA1_NM_001903_-1.59557
GGTGCAGAATCTCGGCGGGGAGCTTGTTGTCTCTGGG 876. chr5_SIL1_NM_001037633_1.6204
TCTCCGTGACCAGGTCGTAGAGCAGTGTGACCACGCGCACGGCGAGCACC
TCCGTGCCCTTCTCCTGCACCAGGGTCCTCAGGACCTGCAGCCCCCCGAG
CTTCAGGAACTGCCGCTGGG 877. chr5_NRG2_NM_004883_-2.17795
GCGGCGAGTCCGAGCGCAGCGCGTCGTGCGCCCCAC 878. chr5_SLC4A9_NM_031467_1.51669
ATTCCAGTGGTCAGTTCGTCGGGCCAGCAACCTTCATGACCTTCTGGCAG
CCCTGGATGCATTCCTAGAGGAGGTGACAGTGCTTCCCCCAGGTCGGTGG
GACCCAACAGCCCGGATTCCCCCGCCCAAATGTCTGCCATCTCAG 879. chr5_PCDHB18_NR_001281_-1.73783
TCCTGAAGCCGGTGATTCCCAATCTCCTGTCCCGCGACAGCGA 880. chr5_PCDHGA11_NM_018914_1.77239
GCGGGGACCGCAGTCGGCTGCTGCTGCTGCTGTGCATTTTCCTGGGGACG
CTGCGGGG 881. chr5_FGF1_NM_000800_2.48238
CTGCTGCTTGTGGCGCTTTCAAGA 882. chr5_PPP2R2B_NM_004576_-1.55693
CTTTGACGGTCAAGTAGTCCCTGGTCATGATATACCTCCCACTGTGGCTG
AACTTCACATCCGAAATCGAAGAGATAATTTCAGAGAAAAATGATCTGTT

Figure 3-74

GCTTGGATCTTCCGGC 883. chr5_SPINK14_NM_001001325_1.61712
GTGGCCACCACGTGGAATTATTAAG 884. chr5_SH3TC2_NM_024577_-1.87828
CGATACAGTTGGATCCTTGGAAGGAGTTT 885. chr5_ARHGEF37_NM_001001669_-1.54222
TCCAGGGGAATCTGTGTAATGTGCCTTTTCCCTCTCCAAATGCCTAGAAC
CATGGCACTGTGTCTTATTTATTTAACCGTTGGGCTGTCTCATACTAAAC
TTGCAAAGATATTTGCCTATGAACTGAACAAGACTTCCAGGAGTTGAAGT
CTGGTTCACAAGGGTACCC 886. chr5_CAMK2A_NM_015981_1.53857
TGTGGAAGTGGACGATCTGCCATTTGCCATCCCGGCGGTGCCAGACACGG
GTCTCCTCCGACTGGGCGGTGCGTGGGATGCCGCCAGCGTCCAGGTACTG
CGTGATGCGGATGTAGGCGATGCAGGCTGACTCGTC 887. chr5_CAMK2A_NM_015981_2.00608
TGGGGAGAGATATCCAGGAGTCCCT 888. chr5_DCTN4_NM_001135643_1.51752
TTCATGTAGCGAAGGTTGGGAATTGACATGATTCTCACTTC 889. chr5_DCTN4_NM_001135643_-1.55134
CTGCCATGCCCACATCTCTAGACGTCCAGCGACAAAATCCACATGCCAGG
TAATAGGCTTTCTTCATGGTGGTCTTGGCTGGGTCATCTGGAAGCTGTGT
GGAGATGCTCGTGGCCCGAGTAGA 890. chr5_ANXA6_NM_001155_1.6084
GAGGCCTCGGGTCGCAGACGGACGCACGGGCGCAGGGACTCGAGGACGCA
GCGCTCGCTGGATCGGAGCCCGTTAGCCCAGCAGCAACCGCAGCGCGGGG
CGGACCGGGAGGACAGCCGTGGGC 891. chr5_GRIA1_NM_000827_-1.692
GCTCAAGAAGAACGCCAATCAGTTTGAGGGCAATGACCGTTACGAGGGCT
ACTGTGTAGAGCTGGCGGCAGAGATTGCCAAGCACGTGGGCTACTCCTAC
CGTCTGGAGATTGTCAGTGATGGAAAATACGGAGCCCGAGACCCTGACAC
GAA 892. chr5_FAM114A2_NM_018691_-1.50751
GTAGCTGAAAGGCGTCCTGGATGTAGGA 893. chr5_MED7_NM_001100816_-1.58538
CTCGTTTTATACTCCCAGGGCTCCTTATTAAAATATCTAAAAGGTCCAAG
AAATTAATAAGGATAGACATATTAAGTTTTCTCAGTTCTTTCTTGTGATC
AAACTGCATAGGATGAAGCCGTTCGATGCCCTGACTTTCCAAAGGGCGGA
TGATAAGATCAT 894. chr5_LSM11_NM_173491_1.6406
GAGCGCATCCAGCGCCTCCGCCGTCTCATGGTGGCCAAAGAGGAAGGGGA
CGGGGCCGCAGGAGCGGGCCGGAGGGGTCCGGGTCGGAGCAGGAAGGCGC
CACGCAACGTGCTCACG

Figure 3-75

895. chr5_IL12B_NM_002187_1.52748
AGAGAGTGTAGCAGCTCCGCACGTCACC 896. chr5_IL12B_NM_002187_-1.60397
TCTGCTGCTTTTGACACTGAATGTCAAATCAGTACTGATTGTCGTCAGCC
ACCAGCAGGTGAAACGTCCAGAATAATTCTTGGCCTCGCATCTTAGAAAG
GT 897. chr5_CCNJL_NM_024565_2.06112
AGGTAGACGGCCAGGTGCCGGGCTGCAGGGCAGAGCTGGCAGTGGCTGCT
CAGCAGGGTCAGGATGTCCACGAAGAACCGGCGGCTCTTC 898. chr5_GABRA1_NM_000806_1.51047
GCGTGTAACCGAAGTGAAGACTGATATCTTCGTCACCAGTTTCGGACCCG
TTTCAGACCATGATATG 899. chr5_SLIT3_NM_003062_2.00581
TGGAGTCCGAGAGGTGGCAGGCAG 900. chr5_SLIT3_NM_003062_1.5941
CTTCTACAAACGAGGAGCCGTCCGTGCACTGGAAGACGTATTTCCGCCGC
TTGCTGCGGGTGGGCTGGCAGCACTGGGGCCCACAGCCCCCACGACATTC
CATGATGGGCACCTTGGAGGCTGTGGCACATGATGCATAACCTTTCTGGC
GGCGGATCACCTCTCGGACTACTTGT 901. chr5_DOCK2_NM_004946_-1.55177
GTGCTGCAGAGCACCCAACCATTGCCAAGTCGGTGGAGAACTTCGTGAAC
CTGGTCAAAGGCCTCCTGGAGAAGCTGCTGGATTACCGGGGTGTGATGAC
AGATGAGAGCAAAGACAACCGCATGAGC 902. chr5_LCP2_NM_005565_-1.51014
TGGTTTATCTTTCTAAGAGCAGCTTCTGCCTCTGGTCGGGTAATATAAGA
AACGTACCACTCTTCATTTA 903. chr5_LCP2_NM_005565_-1.56424
TTGAGAGAAGTATGGTGGCAGGGAGGCACTCTGTGGAAAACTGCTG 904. chr5_KCNMB1_BC025707_1.59879
GACAGGGACAGTTAGGAACAGGCTCACACAC 905. chr5_---_---_-1.66528
TTTTTCGGCAAGTCTCGCTCTTGTGCCCCAGG 906. chr5_---_---_-1.78717
CATGGCTCACTGTAACTTCTGCCTCCCGGGTT 907. chr5_NKX2-5_NM_004387_-1.66293
CTTTTCGGCTCTAGGGTCCTTGGCTGGGTCGGGGTCGCTGTAGGCACGTG
GATAGAAGGCGGGGGCGGCGGGAAAGGCAGACGCACACTTGGCCGGTGAA
GGCGCGCGGCCCAGCTCTGCGCGCAGCTCTGGGAGGCCCGGCGCAGCCGC
CTCGGGCCCAGCGTAGGCCTCTGGCTTGAAGGCGGCCAGCATGCAGGAGG
AGGGCGCC 908. chr5_HMP19_NM_015980_1.9626
CCCAGCCTCCCTGGATGCTTACTACTCCTCCCAGGACCCCAATTCCAGAA

Figure 3-76

GCCGCTTCTACACAGTCATCAGCCACTACAGCGTGGCCAAGCAGAGCACT
GCCCGGGCCATCGGGCCGTGGCTGTCAGCAGCCGCTGTCATCCATGAGCC
CAAG 909. chr5_NOP16_NM_016391_2.37281
ATTCGATCCGCGGCGCTGCCTTCC 910. chr5_CDHR2_NM_001171976_1.50095
GATTCAGGGAACAATGGCGTCATCCTGTTCTCCATCCTCCGAGTAGACTT
CATCTCTAAGGACGGGGCCACCATCCCTTTCCAGGGTGTCTTCTCGATCT
TC 911. chr5_HK3_NM_002115_-1.76406
CAAGCCCGTCTGGTGACAAGGGAAAGAGAAGCTGAAGCCAAGCTGCAGAC
CCTGTTTGTTCACAGGCTGCGCATCCAGG 912. chr5_ZNF346_NM_012279_1.56737
GTCGTGGCCCAGTCGCACTACCTGGGGAAGACCCACGCAAAGAACTTAAA
GCTGAAGCAGCAGTCCACTAAGGTGGAAG 913. chr5_FGFR4_NM_002011_-1.84236
TGACCTCCAGCAACGATGATGAGGACCCCAAGTCCCATAGGGACCCCTCG
AATAGGCACAGTTACCCCCAGCAA 914. chr5_FGFR4_NM_002011_1.75407
GGCGTCCACCACATTGACTACTATAAGAAAA 915. chr5_NSD1_NM_172349_-1.58945
GTTAAATCACTCACCCAGGCCAGACTTCTTTCTCAGCCTCCTGCCAAGGC
CTTTTTATATGAGCCAACAACTCAGGCCTCAGGAAGAGCTTCTGCAGGGG
CTGAGCAGACCCCAGGGCCTCTTAGCCAATCCCCGGGCCTGGTGAAGCAG
GCGAAGCAGATGGTCGGAGGCCAGCAACTACCTGCACTTGCCGCCAAGAG
TGGGCAATCTTTTAGGTCTCTCGGGAAGGCCCCAGCCTCCCTCCCCACTG
AAGAAAAGAAGTTGGTAACCACAGAGCAAAGTCCCTGGGCCCTGGGAAAA
GCCTCATCACGGGCAGGGCTCTGGCCCATAGTGGCTGGACAGACACTGGC
ACAGTCTTGCTGGTCTGCTGGGAGCACACAGACATTGGCA 916. chr5_MXD3_NM_031300_-1.55748
TGGGGGGGTCGCTTCTTCCTCCTGTGGATGGGGCCTGGACTGCGATGCGG
GCACAGGGACGCATAACCATGCTCGGCC 917. chr5_B4GALT7_NM_007255_-1.61457
GCAATGGGATGTCCAACCGCTTCTGGGGCTGGGGCCGCGAGGACGACGAG
TTCTACCGGCGCATTAAGGGAGCTG 918. chr5_GRM6_NM_000843_-1.50701
GAGGAATCCTACCCAGGCCTGAGTGCCTCCATCCAGATGCACAGCCCCAG
GTCTCCTCTTGCTGAGACAGCTCCTCCTCCACTCCAACCCCATGTTTCAT
TCTGGGGTCTACACGTTCTTCCACACTGCCCAATCCCCAGGTTATGGGGG
TTGACTGAGGGGAGGAAATCTCCCGCAAACCAGGCAAAGCCCAGGGCTTC
ATCATCCTCTTTGGACTTCGGATGAGAGAATAAGTTTAGTCCCTTTCTAG
AGCTAGAACCTTCTCGGTGGCTGTTTCCCACCATGGGAAGCGAGTCTGGT
CTGTGGTGAGGAAGCATGAAGCTCACATGCTGGAATCGGGGTAGAGCTGG
GTCCAGTTCCTTCTCAAGGCCAGCCCCACCGACGCGGAGCATGGTCTTGG
CAAACTCCCTGCCACTGACTGTTCACCGTGGACCCGGG

Figure 3-77

919. chr5_ADAMTS2_NM_014244_1.50764
TCTGCAGCGTCTCCCGGCCGTCCTCGTCTCTGTACTCCCACTCCACGCCC
ATGGCAATGAAGGTTTTGGAACTGGCATCCACGTCATTC 920. chr5_---_---_1.50354
GAAGATAAATTTGGAACGTTTTCAAAGGGAAAGCAAAATTCGTGAAAATA
CTTAT 921. chr5_RASGEF1C_ENST00000393371_1.59387
CATTCTCCGTCTTCTCATGGCCTCTCAACTCTCCTGCAGGACCCATCTCT
TGTCTACTCCTC 922. chr5_GFPT2_NM_005110_1.58757
TGCCCACGGTGTTGGTGACGCCCAC 923. chr5_GFPT2_NM_005110_-1.87153
TCTCGGGCTCCTTCGCGGCTCGAGGGGGTCTGCCCGTTCGGACGCTGGGG
CTCCT 924. chr5_MGAT1_NM_001114618_-1.64635
CACCTGGTCACTGCTCCACCTCATGCTGAGAGGAGCCTGTGTGTCAAACC
CCAGGGGAAAAAGGGACAGGCAGATCGAATTCTGTCTTCTA 925. chr5_BTNL3_NM_197975_-1.62107
ATCAGTTCCATGCTGTGGTCCACCTCTACAGAGATGGGGAAGACTGGGAA
TCTAAGCAGATGCCACAGTATCGAGGGAGAACTGAGTTTGTGAAGGACTC
CATTGCAGGGGGGCGTGTCTCTCTAAGGCTAAAAAACATCACTCCCTCGG
ACATCGGCCTGTATGGGTGCTGGTTCAGTTCCCAGATTTACGATGAGGAG
GCCACC 926. chr5_TRIM52_NM_032765_1.53292
CACATCTGGCGAATTATCTGGACCATGTTGGCCAGCTGCAAGTTGGGACG
AAAGCTGCGACGTGTAAAGCTCTTTCGGCACTGGGGGCAGGTGAACTGCC
CTGGAAGGGGCAAGGAAGGAGGCGGGTGGATGTCAGGATACAGCTCTTCA
TCTTCGTCCTCATCGTATGCTTCCAGTATTTCTTCTTCTCGGTAGACATC
AATTCTCAGGTCAGGTCTCAAGCCTCCTAGGTA 927. chr6_SERPINB9_NM_004155_-1.51858
CATCTGGGTTGCGGTGTTTCCCTTTGCCCCTAGGAGAACCATGGCCAGGG
CAGAGGAGATGCTCACAGGAGAACAGAACACGTTGTGCGAAGGGTTATCT
TGACACAGTATCTTTAAAAGGCGTATGGCAAAAGTACCA 928. chr6_PRPF4B_NM_003913_-1.51482
GCAGATCACGCTTGCGAAGGCGGTCTCGATCACGCGGTGGTCGTAGACGA
AGGAGCAGAAGCA 929. chr6_RREB1_NM_001168344_-1.62594
GGGATGGCAACTGCGGTCACCCTGCTAAAGTCGGGGCGGGGGCGGCGGTC
CTCCCCCTCACCCCCCCCAGTCCGAGCGCCGCCGCCGCCGCCGCCGCCGC
CGCCGCGGCCGCTCAGTAACACGTCCC 930. chr6_CAGE1_NM_001170692_-1.70698
GTGGGAGGGGAGAACGCTTTCCAACCTCCTCCACCAAGGACTCTCACAAAC
TCGCAATCGGGCTCCCGGAGTGCTGGAACGCCCCTGTGTGACGTCCGCCC

Figure 3-78

GCGCCGGGGGAACTCCGCAGAGACAGGTGCAGCCCGCGAGGCCCGAGCGA
CCCTACTGTGGGTGCGGTGTCTTCCCAGAGAGTGGTGAAGTTAGGAAGGT
ACGACCCCCTAGGCCGAACAGCCTGTGGGCTAGCTGGCGCCTCCTGCCGC
AGTAAACACAAAGTGG 931. chr6_DSP_NM_004415_-1.78259
CTGGCCTCATACACCTCAGGACTGGAAACTCTGCTGAACATACCTATCAA
GAGGACCATGATTCAGTCCCCTTCTGG 932. chr6_GCNT2_NM_145655_-1.54032
TTGAGCCCGCCAAAAAGTTATGAGAAGCTGAACAGTTCCAGTGAAAGGTA
TTTTAGGAAAACTGCCTGTAATCACGCCTTAGAGAAAATGCCAGTCTTTT
TGTGGGAAAATATATTACCATCACCTTTGCGAAGTGTCCCTTGC 933. chr6_ERVFRDE1_NM_207582_1.58767
GAGTGGCTCGTTCCCGTAAACTGGAGGCTTGATTTAGGAGTTGTCTGATG
TTGTCTTGTACTTTTCCTGATTGATTTACCCAAAAGCAACATTTTTCATC
TAAGGCCAAACAAATTCCTCCCTGTGCTGCCGTTAACATGTCTAGTCCTC
GACGATTTTGAAGGACTACGGCTGCTAAAGAGTCGATTTGTTCTTGCATG
GTCGTTAAGGCTTTAGCCATGGTGTCAATGTTGTTGGCTATTTCCTTTGA
GAGCTGGCTATAGGTGAGGGAAGCTTTTGTGATTCCAGCAATTCCGGTTC
CCGTACCAGCTAGAATGCCGAGTCCCGCGAGAAGGGGAATGAAATGGATT
GCCCTCCTCACCCTGGGCAACGGGGAATTCCCATAGATTGGTATTGGAAG
AGAGAGATTGCCAGGGGCTATGAAGATGTCTGGGGTTACATAGCCTATGG
TACAAGTTCCAGTCCAGTTACTGGGGAGGCATTGGTGAATCGACTGGCCA
CAAATATAAAAGGCTCCTTGAGTTTTAAGGCATGTAGAGATATGGAAATG
AAATAAGGGGGTGAGGGAGGTTCCAAAAAATTCTGAGACTGCTGATATGC
CCAGGTAGCTGGTGGCTATAGTCATGCCTGCTAAGACTTGGACGCAGGGT
GTTTGGCTCTGGTTAGCTCCCTTGGTTTTATTTTCCCAAAAAAGAGAATT
TCGAGTTTGGTCCAATAGAACCCATTCCGCTGTAGAGCTGAGGTTGGAAA
TTTGCAGACATTGGTTATAATCAGCAGGCCGGAACCAGAAGTTTC 934. chr6_TBC1D7_NM_016495_1.95117
GTTGAGACTAAGTGGTCCGGGAGAAGCAGAGGAAGCCGTGCCCTGTGCGC
TGACCGA 935. chr6_NUP153_NM_005124_-1.63622
TTCTCTATTTTGTCCGGGTGTCATATTTT 936. chr6_SOX4_NM_003107_-1.53255
TGGGGTTAGCAAACCGCACGCCAAGCTCATCCTGGCAGGCGGCGGCGGCG
GCGGGAAAGCAGCGGCTGCCGCCGCCGCCTCCTTCGCCGCCGAACAGGCG
GGGGCCGCCGCCCTGCTGCCCCTGGGCGCCGCCGCCGACCACCACTCGCT
GTACA 937. chr6_SOX4_NM_003107_-1.73779
GGTGAAGCGCGTCTACCTGTTCGGCGGCCTGGGCACGTCGTCGTCGCCCG
TGGGCGG 938. chr6_MRS2_NM_020662_1.62326
CGGCGCAGCTTTGCGGGCCCGACCGGCTCCGCGTGGCAG 939. chr6_FAM65B_NM_014722_-1.67492
CACCTGAGGACTGTCGGCGGCAAGCCTCAGATGG

Figure 3-79

940. chr6_LRRC16A_NM_017640_1.87246
GCTTCTCAAGCCCTAAAAACAAAC 941. chr6_HIST1H1T_NM_005323_-1.65751
AAAGGGCCTCGGTGATCAACTTGGACACAGAGAGGTTCGGCACTTTGCGA
CTTGCACTTATCAAGCCAGCCGGCTTCCTCCCTCGCTTCTTGGTTGGAAG
TTTCTCCATAGCGGCTACACCAGCACTGGCAGAAGCTGCAGGCACGGTTT
CAGACA 942. chr6_BTN2A3_ENST00000297020_1.67118
AGTTCCCCAGTCTCACAGCCATGGAAACAAGCCCTGGCCATCTCAGCAGC
CACTGCACAATGCCTCTGGTGGAA 943. chr6_ABT1_NM_013375_1.50942
ACGTGAACGGGCTCGCCTGGCAACTGCCCAGGACAAGGCCCCGCTCCAACA
AAGGGCTCCTGGCCAGGATCTTTGGAGCCCCGCCACCCTCAGAGAGCATG
GAGGGACCTTCCCTTGTCAGGGACTCCTGA 944. chr6_HIST1H2AL_NM_003511_-1.9978
ACCCGCTCTTCTCGTGCCGGTCTCC 945. chr6_OR2B6_NM_012367_1.78215
GCCTTGGGGGCTACTGAATATCTT 946. chr6_GABBR1_NM_001470_1.51155
AAGAGCACAACAAGAGTGATATAGGAGGAGAAAACTATGGCAAGAGAGGC
AAAGGCAAAGGCTGCATCCTGCTGGCTGGACAGAATCATGGTGACAGGAG
CAGTGATGAGGCACAG 947. chr6_LOC554223_BC051362_-1.60794
CCCAGCGCTGGGCATTCCCCATCTTTGCA 948. chr6_TRIM39_NM_021253_1.60328
GACAAGTCTGTTAGAGGCTGGGGCCTC 949. chr6_---_---_-1.64494
AACATGAAGATATCCTCCCAGGGTTGAAGT 950. chr6_---_---_-1.57912
ACATTGTAGCTCCATCACCCAGGCTGGAGTGCAGTGGCATGAACATGGCT
CACTGCAGCCTCCACCTCCTGGGTTTAAAGGATCTTCCTGCCTCA 951. chr6_C6orf134_NM_024909_1.77956
TGGAGTTCCCGTTCGATGTGGACGCGCTGTTCCCGGAGCGGATCACGGTG
CTGGAC 952. chr6_DHX16_NM_003587_-1.54294
TGGTGTCAGGTTCTGTTTACGTCCTTCT 953. chr6_DHX16_NM_003587_-1.50795
ATGTCCACAGGAAACCTGCGTCCGGGGATTCGAAACACAGGGGCGTCATC
AAAGAAGGTGGAAAAACGGGCAGTGTCCATTGTGGCTGAAGCCACCAGGA
CCTTGAGCTCAGGTCGGAAGCGAGCAACATCC 954. chr6_DHX16_NM_003587_1.56169

Figure 3-80

TCCGGTCTTCCTCGGCCATCTTGAGGCGCTTCTGAGCCTCT 955. chr6_MDC1_NM_014641_1.78904
AGGAACTTGACTGTCCGGCGGATGCGATCAGTGACCAGGTGGGAAGCCTC
TGCCGCTGAACCAGCCAGACTTCCCCCCAGTGCCAGCACAGCCCGCTCTC
CCCGAGCATCCACCACTCCTGTGAAGA 956. chr6_FLOT1_NM_005803_-1.68388
GACAAGGCACAAACTATTTGGCAAGGAGAGATGAGGGGTGGGACCTCACT
GTCAATGGACATGCTCAGGGAGGCCAGTGGGTTACATGCAACAGGAGGAT
CATTCAGGCAACTTCAGCTATGAGGCTGG 957. chr6_CDSN_NM_001264_-2.186
CATCCAGGGTGCCCGAGACGAGCCCAT 958. chr6_---_---_-1.67875
ATACAAAATTTAGCCGGGAGGCTGAGGCAGGAGAATCGCTTGAACCCGGG
AGGTGGAGATTGCAGTGAGGCGAGATTGAGCCACTGT 959. chr6_LTA_NM_000595_-1.57145
GCCCGTGCTTCGTGCTTTGGACTACCGCCCAGCAGTG 960. chr6_BAT2_NM_080686_-1.54523
AAAGGGAGTCTGCCGAACAGTCGTCTGGGCCCGGACCAAGCCT 961. chr6_C6orf26_AJ245661_1.57672
TTTCTTTAGTCTCAAAACAAGAGACTAGGA 962. chr6_C6orf27_NM_025258_1.51891
AGAAGGACAGGGACTACAGTGCTAGGCTGAGGGGCAGCCCTGTGCAGGCG
CCGCCCCGCTGCGTCCTGGCCAATCAGCTCCAGGGAGAAGGGTCTAGGGG
TGGACAGCAGCGTGGGCGACAGCGAGGCTGCGAGGAGACCTCGCTCCGGA
GGTCCCACGGGCTCCAAGGGCACCTGGCCTAGTTCGGCACCCTCTGGGAC
CCCTCGAAGGATGACGTGGGAGAAATGCGGCTGAGGATCCCCA 963. chr6_C6orf27_NM_025258_-1.80749
CCATCCTCCATGGGGATCCCAAAGTG 964. chr6_C6orf27_NM_025258_1.56676
TGCTGATGTCTCCGTGGATCCGGACTGTGATCTTCTGGAGCAGCCCATCC
ACGCTGAACACAAGTGG 965. chr6_C6orf27_NM_025258_1.55098
GATGAGTTCCAAAGTAGCCAGAGGTGAGGAGTGTGAAGCCCAGCCAATTC
CTGGGGCAGCTCAACTCCTCGCAATCGGAGCAGGTAGGATCGGCCA 966. chr6_C6orf27_NM_025258_-1.92598
CATGAAGTGCAGCCCCGAGGCGCTGGCGAGCCAGGGTGTGGTCAAGGGCC
CTGGCTGCCACCACGGTCTCCCGCAGAGCCCCTACCAGGCGCGCGCGTCC
CTGACCCAGTCGCTCAGCATCAAAGTGCAGGTCGGGGTCATTCCTGGAAG
TTGGCAGGAAGTCCTGGGCTGCATTGGCACGAGACACCTC 967. chr6_VARS_NM_006295_-1.51869
CACGAAGGGCAAACTTGGTGGCATTCCAGAGCTTGTTGCAGAAGTGGCGG
TAACCCAGTATCCGGTTCA

Figure 3-81

968. chr6_SLC44A4_NM_025257_-1.66027
ATCCCCACCACGATGTAACCTAGAATGAAGAGCAGGAAGAGGACGCAGCA
GATGACATC 969. chr6_EHMT2_NM_006709_1.71193
AGCACATGGCAGATCTCCACGGAGCCCTTCTGGGCGGCTGCATGCAGGGG
CGTGCGCTTGCTCTGCTGGTCGCTCTGGAAGTTGG 970. chr6_CFB_NM_001710_-1.55321
GGGTACTGCTCCAACCCGGGCATCCCCATTGGCACAAGGAAGGTGGGCAG
CCAGTACCGCCTTGAAGACAGCGTCACCTACCACTGCAGCCGGGGGCTTA
CCCTGCGTGGCTCCCAGCGGCGAACGTGTCAGGAA 971. chr6_CFB_NM_001710_1.56309
TCCAGGCAGTGTACAGCATGATGAGCTGGCCAGATGACGTCCCTCCTGAA
GGCTGGAACCGCACCCGCCATGTCATCATCCTCATGA 972. chr6_C4A_NM_007293_-1.83691
CTCCGCGTGCGGAAGAAGGAGGTGTACATGCCCTCGTCCATC 973. chr6_TNXB_NM_019105_-1.54129
GCGTTTCCCATTCTGGAGTCCAAAGAGCAGGAACTTGTACTTGCGGGCCG
GGTCCAGCCCCGAGACGGCGACCGCTCGGAGGTCTCCGCTCACAGGCACT
GCCTGGGGCTGCCCCTGCGCGTCCCTGTACTGTACCAGGAAGGAGTCAAA
GGGGCCCTGGGCCACCGTCCATGAGAGGCCCACTGAGTCCGAGGTCA 974. chr6_ATF6B_NM_004381_-1.71734
ACCAGGGACATCTTGGGCCGGGAGGTCTTGTTGTGGCTGATGGCTG 975. chr6_PPT2_NM_005155_-1.65263
CACGGACTACTTGAAGTGGCTGTTCCCCA 976. chr6_PPT2_AF020544_-1.80981
CCACCCACCAGTCTGAGCTGCTTCTG 977. chr6_NOTCH4_NM_004557_1.5147
CAGCCAGCATCAAGGGTGTGGTCCCGTCCTCTGTGCGAGCGTCCACTGCA
GTTTGTCTGCTACGGAGCAGA 978. chr6_NOTCH4_NM_004557_1.66674
CCCAGGGGTGATCCTGCTGTGGCCT 979. chr6_BTNL2_NM_019602_-1.67289
TCCCTCCATGTGGATGCTAGGGGCAGACCCC 980. chr6_HLA-DPB1_NM_002121_1.52372
CCTGGATAGTCCTGTCACCGTGGAGTGGA 981. chr6_COL11A2_NM_080680_-1.59386
TCCCACCACTCCTGGAGGACCAGGG 982. chr6_RXRB_NM_021976_1.63874
TCTGTCCCCGCAGATTGCACATAGCCGTTTGCCAGC

Figure 3-82

983. chr6_VPS52_NM_022553_-1.51953
GATCTGATAGTTGGTCATGGGTTTCCTGAAGGAATAAATCTTCTGGAGGA
TAAACTCTCGGATCTTCGTCACTGC 984. chr6_ITPR3_NM_002224_-1.65611
CATGTTCCTGCGCGTGCTCATCCACCTCACCATGCACGACTATGCGCCGC
TGGTCTCGGGTGCCCT 985. chr6_IP6K3_NM_054111_-1.74972
CGCTTGTTCTCTGGGTACTCGGAGCACAGGCGGGTCAGGTGGGCCTGGTG
GCATTGCAGGCCCCACGGGTTGAAGCT 986. chr6_C6orf1_NM_178508_1.55842
AGTCGTATGCTCATCGTCCCAGGTCAAGGGGGCATGCCAGGGTGGGGAGG
GCGTCAGGCCGCTGCTAGGATGCGGGCCAGCAACAGCGGACAGGAGGTGG
TTCCCACGGCGCTGGGAGGCTCAGGCCGGAGGTGGGGGTGTTGGGGGATG
CGGATGGGCCGCCCCGCGCCCGAACATCCTGGAAGCCCGTCACCCGAGGC
GTG 987. chr6_NUDT3_NM_006703_1.81983
CAAAAATTCCAACTAATCTTCCCA 988. chr6_SPDEF_NM_012391_-1.58467
GCACGAACTGGTAGACGAGGCGCTGGGAGATGTCTGGCTTCCGGATGATG
CCCTTCTTGTAATACTGGCGGATGGAGCGGCTCAGCTTGTCGTAGTTCAT
GGCGGGACGGTTCTTGC 989. chr6_SCUBE3_NM_152753_-1.60981
TACCACGGCCAGACGGAGCAGTGTGTGCCATGCCCAGCGGGCACCTTCCA
GGAGAGAGAAGGGCAGCTCTCCTGCGACCTTTGCCCTGGGAGTGATGCCC
ACGGGCCTCTTGGAGCCACCAACGTCACCACGTGTGCAG 990. chr6_DEF6_NM_022047_1.83249
CTCTGCTTGCCCACCGTGACTCCTCCCTAAAGCGCCTGACCCGCTGGGGA
TCCCAGGGCAACAGGACCCCCTCGCCCAACAGCAATGAGC 991. chr6_LOC100131043_AK124222_1.67895
GTGCTGCCTGTTGGTTTCTGGTGAACTCATTTCCCCTTTCCCTGTCTTTG
TTCCCACAGAGGCCGTCAGCTGATCTTTACCGTGGTCTCTTCTGTC 992. chr6_FGD2_NM_173558_-1.63758
CCAGAGAAGAAGATCGTCCAGGAGCTGCTGGAGACAGAGCAGGCCTATGT
GGCGCGCCTCCACCTGCTA 993. chr6_RNF8_NM_003958_-1.64327
TCTTCGTCACAGGAGACCGCGCCGGTGGCCGGA 994. chr6_ZFAND3_NM_021943_-1.56042
AGGCAGCATACGTCCCAGGGACAGTGGGTTTGGATCTGTCTAGAACAGCG
GTTTGTGGCTGTGGCCCAGCTCCGAGAGTGATATTTGCTCTGGTAGGTGA
GGGCCTGAGGGTACATTTCTC 995. chr6_GLP1R_NM_002062_1.77439
CTGTGTCCCTCTGGGAGACGGTGCAGAAATGGCGAGAATACCGACGCCAG
TGCCAGCGCTCCCTGACTGAGGATCCACCTCCTG

Figure 3-83

996. chr6_C6orf64_BC022007_-1.5229
GCTGCCTTTAGAGTCGCTGCTGCTTCCGCCTTCTCTCCTGGGGTTTGTGC
GCCCTGACTGGCAGCAGGGGGTTGGGCCGCCAGACCCGCCCGTTTCCGCG
CCGCCCGAAACTCAGCTAACCGCTGTTCCAT 997. chr6_KCNK5_NM_003740_1.66307
TCATGGCCTTCTTCCCGATCTGCTTGATGAGGTCGTTGTAGGTCTCTTCC 998. chr6_DAAM2_NM_015345_-1.80422
CCCCCCGCAAGAGGAGCCACCATGGCCTGGGCTTCCTGTGCTGCTTCGGG
GGCAGTGACATCCCCGAAATCAACCTCCGGGACAACCACCCTCTGCAGTT
CATGGAGTTCTCCAGCCCCATCCCGAACGCAGAGGAGCTCAACATCCGCT
TTGCAGAGCTGG 999. chr6_TREML2_NM_024807_-1.70191
CAAGTAGACTTCCACATAGGGCTCTGGTCTTCCAGGTGGGTCACGTGTAG
AAGGATCGCTGCACATGCTGTAGC 1000. chr6_TREML4_NM_198153_-2.52607
TCCTGTTAGTGCTCCTGATCTGCA 1001. chr6_TOMM6_NM_001134493_-1.66157
CAGACCGGAGGTGCGTCATTCACCGGCGACGCCGATACGGTTCCTCCACC
GA 1002. chr6_CCND3_NM_001760_-1.8326
GTGCCGGGTGCCTTCGCAACACAGCAGCTC 1003. chr6_TRERF1_NM_033502_1.76472
GAACAGCACAAATTCAGAAGATTC 1004. chr6_PPP2R5D_NM_006245_-1.65386
GTCCCAGCAATAGCACGCCGCCCCCCAC 1005. chr6_CUL7_NM_001168370_-2.27433
CTGGCACAGGTATCTGAGGAACAC 1006. chr6_MRPL2_NM_015950_-1.53541
ATCCCCGGCTCCATTACTTGTAAGGGAATTGGG 1007. chr6_CRIP3_NM_206922_-1.63288
TCAGCATGACTCCCAGCAGTCAGGGTCTTGTGGCAACGCTGGCACCTCAG
ACACGGTCGGTGCCAATT 1008. chr6_DLK2_NM_023932_-1.91104
GGGTCCAGCCTTGCGCTCGCAGTCACGCCCATGGAAG 1009. chr6_TJAP1_NM_001146016_-1.80238
AGCGGTACCGGCTGGACTGCAACCTGGCTGT 1010. chr6_YIPF3_NM_015388_-1.69562
TGGGGGAAGTTGACCATCTTGATAG 1011. chr6_POLH_NM_006502_1.53766

Figure 3-84

GAGAGACTGACTAAAGACCGAAATGAT 1012. chr6_CAPN11_NM_007058_-1.65863
TGAGAGGGCACGCTTACTCTGTGAC 1013. chr6_HSP90AB1_NM_007355_-2.19655
CATCTCCCGAGAAATGCTCCAGCAG 1014. chr6_GPR116_NM_015234_2.05788
CACGTAGGTTGGATTATCCTGTTC 1015. chr6_TNFRSF21_NM_014452_1.51783
ATGGCCATTGCAGTAGTAGATCCATTTCTCCCGGTTCTGGGTTGGAGTCA
TGGATTTCTTCAGCCCTGCCTTTTCCACAATGGCACTGGGATCCTGCCGG
GGCCCCTTTTTCAGAGTCCTCGAGCTTTTCCGGATACTGCACACCACAAT
CACCACAAGCACCAGCAGCAGGAAAAGCACAATCATCCAGGGCAAATGCT
CATTGATGTCAAAATGCTTGTGTAGGTTCTGTCTAGGATGTCCCC 1016. chr6_TNFRSF21_NM_014452_1.55214
GAGAAGGGAGCCCGCGATCATCGTGGCTGTGGCTCG 1017. chr6_OPN5_NM_181744_1.58889
CTGCACACCGTAACCACAGTCAGGAA 1018. chr6_PKHD1_NM_138694_-1.79411
CCTGAATAGTTTCCGGGTGTACTGAATGAAGGCAGA 1019. chr6_LRRC1_NM_018214_-1.70378
GCTCCCGCTCCAGGTTCCTTGAAGCACTTCCGACCGCGAAGCCCGGCGCG
AGAAGCGAGCTAACCCAAGAGCCAACAACGAGCGCGGA 1020. chr6_LRRC1_NM_018214_1.92541
ACCCAGCTGCGAAGACTAGAAGAA 1021. chr6_DST_ENST00000446842_-1.60396
ATCAGCAGGAGAAGCCGTCTCATCATTTTCCTCTTGCAGTGTGTCGTAGT
CCTCAGGGTGCAGGCAATCACGATCATCACCATCAAGAAGCAAAGAATCA
TGGTCATCATCTTCAAACAAGGGAGTATC 1022. chr6_COL19A1_NM_001858_-1.69103
TGAACCTGGAATTGGGCTGCCAGGGAGTC 1023. chr6_OGFRL1_NM_024576_1.64618
ACCTGCTCGGCGGGGTCAGCTTCCGCGAGCCCACCACCGTGGAGGACTGC
GACTCCACCTGGCAGACCGACTCGGA 1024. chr6_KHDC1_NM_030568_-1.82262
TCGAGACCACAGGGGGGTCAGGTAGCCAAGGCTGGGCTTTGACGGTAGGA
ATGAAGGAGGTGAGGGTGGCGCGCCGCAGGCCTGGGCCACTCCCTGAGTA
GGGCGGCG 1025. chr6_MYO6_NM_004999_-1.70183
GTTTAAAGCTTTGGGCTTAAATGAAAATGACTACAAGTTTGGGTTA 1026. chr6_TPBG_NM_006670_1.79078

Figure 3-85

TCCTCGGCGCCGTTCCTGGCTTCCGCCGTGTCCGCCCAG 1027. chr6_PNRC1_NM_006813_-1.77316
TGACTGTCGTCTCCGTCCCGCAGCGGGAGCCGCTCGTCCTGGGTGGCCGC
CTTGCGCCGCTTGGCTTTT 1028. chr6_CCNC_NM_005190_2.33242
AGTGGGAGCTCTGCCAAAAGTTCC 1029. chr6_SIM1_NM_005068_1.85752
GGATTTTGACTTTGAGCTGGAGAGCCGGGATTTGGCCCCCTTTCTGTTGT
CAGTCA 1030. chr6_PREP_NM_002726_-1.57301
CTTGGTGTCAACGTGGGAAAGCCCTTGAGGTTTTCTGTCGCTGTCAGGAG
GAAGCACGAAAACT 1031. chr6_C6orf203_NM_016487_-1.80979
GGAGGCCTGCAGTCCGCGCGGCCGCG 1032. chr6_---_---_-1.63023
AGGGTCTCCCTAAGTTGCTCAGGCTGGTCTTGAACTCCTGGGCTCAAGGG
ATCCTTCCACCTCAGCCTCCCAAAGTGCTGGAATATGAGGTGTG 1033. chr6_C6orf182_NM_001083535_-1.54534
TACACTGAGACTTCGTCACACATAAAACAAGCACGACAAAGAAAGAGGGC
GCGAAGGGACTCCTGGAAGAAATTGAGTCTACATTTAAGATCACCCTAAA
AGTAGTGACGGCCTCTTCATTACTCCAAA 1034. chr6_AMD1_NM_001634_1.8733
GAATTCGTGACCTGATACCAGGTT 1035. chr6_TRAF3IP2_NR_028338_-1.63217
CATCCTCGTCCAGCTGCGACTCAGCGCCTTCCACGTCCTGTTTGTATTT 1036. chr6_TSPYL4_NM_021648_-1.52794
TCCTTTTCCACTGCTGCCGAGATGGCGCGTTTTTTAGTCGTCAC 1037. chr6_HINT3_NM_138571_-1.74031
AGACTGCGCGGGCCCGGTAGCCCTGGAGAGGCCGAGGCTCTAGGCCGCGA
GGGGC 1038. chr6_PTPRK_NM_001135648_-1.61665
TCAGGGGCGAAAGCGTCGCCAGCGTCGCCGGCC 1039. chr6_LAMA2_NM_000426_-1.50214
AGCCCAAGATGAGGTGTACCTGCACCCATCTGAAGAACATACTAATGTAT
TGTTACTTAAAGAAGAATCATTTACCATACATGGCACACATTTTCCAGTC
CGTAGAAAGGAATTTATGACAGTGCTTGCGAATTTGAAGAGAGTCCTCC 1040. chr6_LAMA2_NM_000426_-1.82087
CCCTGGAACTGAGGGGCGTTCAACCTGTATCATGCCCAGCCAACTA 1041. chr6_MED23_NM_004830_1.61785
ATACAACGAGTTCTCTCTTGCTGAAATCTTTGTAAAAATGGTCCAACAAG

Figure 3-86

ATGGTATACATAAAGCAACTGGAATTCGGTCTTCACTATAGGAAGAAGTA
C 1042. chr6_SGK1_NM_005627_-1.55968
CCCTTTCCGATCACTTTCAAGAAGTGAAAGTCAGATGGTTTAGCATGAGG
ATTGGACGACGGGCCAAGGTTGATTTGCTGAGAAGGAC 1043. chr6_AHI1_NM_001134831_1.63331
GGAGCCGACACCCGGAGCAGTGCAAATCAACTCCCCCAGCCTAGCGGCGC
GTGCGCGAAGTGAGGCGGCCACGCAGCCACCTAACCCGCCAGCGACCCGT
GTCCTGAAAGCAAGCCGCGGCTCTGT 1044. chr6_TNFAIP3_NM_006290_1.59031
CAGAGATGTGAAGCCAGATCCTCAT 1045. chr6_NMBR_NM_002511_1.59749
GCTTCGGGAACTGCCAGCAACACGGAGACCACCCAGATACCCATGGCCTT
CACACAGGTCCGCAGCAATGCCCCTGACGTCTGCAT 1046. chr6_VTA1_NM_016485_1.59155
TGTAGCAAGTAATACTATCCAACCTACTCCACAGACTATACCTGCCATTG
ATCCCGCACTTTTCAATACAATTT 1047. chr6_ADAT2_NM_182503_1.54452
TCCACTTTTCGGTCTCCTCTGCCGACACCGAGCACGCGCCGCTTGCAGCT
GGCTT 1048. chr6_FUCA2_NM_032020_-1.67726
GCAGGCCGGCTGTCCTCTCTGCAGGCTCCCGCGGCCTCGGGAGCGCTGTT
CTTCCGTCTCTGCCGCTGAGTATGCCGCGCCG 1049. chr6_EPM2A_NM_005670_-1.76823
AAATCTTCTTGTGCCCGGGCCAAGGC 1050. chr6_SHPRH_NM_001042683_1.52347
CCATCACGCAAGGTAGGTGGTATCCCTGGGTGCCTGGCTATCAACAATTC
CAT 1051. chr6_SHPRH_NM_001042683_1.51934
AGAAGGTGGTACATCACTATCAGCATGATTTAGAGATTCAGCACAGTCCT
CTGTTTCATGTTCTTGGTTGAATTCAGAGATACATGTACTTTTAGACATA
GCAACATCAGTTATTCCAGAGTCGCTAGTAGCTGGACAGTGACCTTGTGA
ATCGGGATTGATAAATGGTTGACTTTTTCCTTTTTTTGTGGATGGAACAA
GCTTTTTCCTCAATTTACTGCGATTTCTCCTGGACTTATAATAATAATAG
TAAGGATCATCATCATCATCAGAGGTGTCTGATGGCAAGTATTC 1052. chr6_STXBP5_NM_139244_-1.52636
ATGGCACCTTGACTATATGGAATGTAAGGTCCCCTGCTAAACCAGTACAG
ACAATCACTCCACATG 1053. chr6_TAB2_NM_015093_-1.64639
CATTTTAACCCCAGCGCTATTCATAACTTT 1054. chr6_LRP11_NM_032832_1.52345
CATCCTGCCCAGCCTTGCTAAGTGGAGGCGCATC

Figure 3-87

1055. chr6_PPP1R14C_NM_030949_-1.54828
AGGACTCGGCGCCCGTGGCCACGGCGG 1056. chr6_IYD_NM_001164694_1.56649
GACCTCAAGCGCAAACCTCTGGACCAGATCATG 1057. chr6_MTHFD1L_NM_015440_-1.50137
GTAACAGACATAAACCTGGGGAAGCTGGTGCGAGGGGATGCCCAT 1058. chr6_SYNE1_NM_182961_1.7308
GCTGGGTGATTGTCTCCAGGCTGCTTGTCTCCAGGAGGTCAGGTGCCACC
AGTCTGCCAGACATCTGCAGCAGCCACTTTTCGACCTCTTGGAGCTCACT
GTTGTAGTCTTCATGGTCTTTGACTTTCGCCTCCAGACTGAAGACA 1059. chr6_OPRM1_NM_000914_-1.57438
TGGGAGGGGGCTATACGCAGAGGAGA 1060. chr6_SNX9_NM_016224_1.61187
CGGTCCGGGAAGCGTATCATAACCACCTGGGAGTTGCCAAGAAGCAGACA
GTCTCCCAGTGTCTGACTCTCGGATATTTGGATTTGACTGGTGTGAGGCA
AAGTGAAAAAGGGATGGGGGAAATGGAGATGGCACGGGCTCCTCAGAGCG
TGGTAGCCGACTGT 1061. chr6_SYNJ2_NM_003898_-1.64893
GCTCTGGGCTTCTTGCCACGCGGGCGACACGCCTATGATCAATTTTG 1062. chr6_EZR_NM_003379_1.81071
TACAGGGCCTCGAACTCGTCGATGCGCTGCTTGGTGTTGCCCTGCCGGAT
CTGCCGCAGCGTCTTGTACTTGTCCCGGCCTTGCCTCATGTTCTCGTTGT
GG 1063. chr6_TAGAP_NM_152133_-1.55405
GTCCAGGGGTGGATTTCACTCCCGTGTGG 1064. chr6_MRPL18_NM_014161_-1.56511
CCCTGTCAACCAGCTCCGAGCCGGCAGCGAAACCTGAAGTGGACCCTGTG
GAAAATGAAGCTGTCGCCCCAGAATTCACCAACCGGAACCCCCGGAACCT
GGAGCTTTTATCTGTAGCCAGGAA 1065. chr6_IGF2R_NM_000876_1.60112
TCTGAGCTCCTTAAGTGGCAGGGCGGGATTCACAGCTGCTTACAGCGAGA
AGGGGTTGGTTTACATGAGCATCTGTGGGGAGAATGAAAACTGCCCTCCT
GGCGTGG 1066. chr6_IGF2R_NM_000876_1.52362
AGTTGTTGTCACGTACTCCAAAGGTTATCCGTGTGGTGGAAATAAGACCG
CATCCTCCGTGATAGAATTGACCTGTACAAAGACGGTGGGCAGAC 1067. chr6_MAP3K4_NM_005922_-1.53231
GGAGGCCAGCCAGTCGGTCTAATTTGAAAG 1068. chr6_PARK2_NM_004562_2.12239
GGGCAGTGTGGGGATTGGCATTCA

Figure 3-88

1069. chr6_T_NM_003181_2.72746
GGCCCCTTGGACCGAGACCTGCGACGGCTC 1070. chr6_RNASET2_NM_003730_-1.57902
TGGGTATCACTCCATATACTCTGG 1071. chr6_FGFR1OP_NM_007045_-1.70357
CAAGTGCACAGACAACACCAAGTAAG 1072. chr6_UNC93A_NM_018974_1.7288
GCACATACCTCACGATCACGGGAAACACACATGCAGAGAAGGCGGGAAAG
CGTGGCAAAGACATGG 1073. chr6_KIF25_NM_030615_-1.63798
GACCAAGCCTGCAGTGCCACCCTCCCCAGGGAGCAAACAGAGGCAGGAAG
GGCAGGAAGGAGCCGCAGAGCTTCTCAAGG 1074. chr6_FRMD1_NM_024919_1.70939
CCATTCCCAGGGTCGGCTCCTGCTGACTGCATGCAGGCCTCTCAGGACTG
GGTTCCATACATCGCGCCC 1075. chr6_SMOC2_NM_022138_1.57358
CCAGTGTCACAGCTACACGGGATACTGCTGGTGCGTCACGCCCAACGGGA 1076. chr6_THBS2_NM_003247_-2.12969
AGATTGAGGTTGGGCCAGCCGTCCAGGTCCGAGTCCTCCCCGCAGATGAG
CCCGTCGCCCGCGTAGCCTGTCTGGCACTCGCACTTGTACATGGGGTCGC
TGAAGTGGCCCAGGTAGATGCACTCCGCGTGCTTGTGGCAGTTGTGTGTC
TTGTCCTTGCATGGGTTTTCGGGCTCA 1077. chr6_WDR27_NM_182552_1.61206
CACAGCAGGTGTCCCAGTCAGGCTGGCATCAAAAACGAGTAACAGATGGT
TGGCCAACCCACAGGCCA 1078. chr6_C6orf208_NR_026780_2.03932
CTCCCGCTGAAGCGGGTTCCAAGGCCACCGTGAGGGGGACCATCCATCCA
G 1079. chr6_DLL1_NM_005618_-1.7637
ATCACCGAGGTCCACACACTTGGCA 1080. chr7_ABCB8_NM_007188_1.80171
TGCTGTCGACACGCCTCACGCTGCTGCTGATGGTGGCCACACCAGCCCTG
ATGGGAGTGGGCACCCTGATGGGCTCAGGCCTCCGAAAATTGTCTCGCCA
GTGTCAGG 1081. chr7_CYP2W1_NM_017781_-1.57817
GGAGGAGCTAGACCGCGTGCTGGGCCCTGGGCGGACTCCCCGGCTGGAGG
ACCAGCAGGCTCTGCCCTACACAAGCGCCGTGCTCCACGAGGTGCAGCGG
TTCATCACGCTCCTGCCGCACGTGCCC 1082. chr7_CYP2W1_NM_017781_-1.98657
GGCACTGGCGCCAGAGGCTTCCTTGGGGCGGGGGGAGGGCACCTCAGCCC
CTGAAGACAAGCAGCACTGCAGTGGCAAAAATGGAAACACTGACCCGGTG
CGGTGG

Figure 3-89

1083. chr7_GPER_NM_001039966_1.57243
CTGCTCAGGCATTCGGCAGGTCCAGCAGAGGTACACCTCCTGCAGCGGGT
TCCAAGTGCACCTCCAGCCTGATGGGCCTGACCAAGGA 1084. chr7_GPER_NM_001505_-1.59193
TTAGTCGGGTGCCAGGACAATGAAA 1085. chr7_MICALL2_NM_182924_1.5681
TGGTTTGCCCTGAAGGTGAGGTTTCTTCTCCTCCTCCTTCCAGCTCTGCA
CTCGGGCTTCCTGGCCAGGGGGCTCCGGCCGAAGCCAGTTGTCACAAACG
TCGAGGCTGGCAGG 1086. chr7_MICALL2_NM_182924_1.63141
GATAGTGGAGGCTTCCGGGCTGGGGCGGGCGAGGGCAGCTTGGCCGCCTG
GACTGGAGCCTTCTTCCCTGACGGCTCCTCCTCAGAGTCCTCCGAGGCCC
TCTTCACGCCTGCCA 1087. chr7_INTS1_NM_001080453_1.82146
GCAGCAGGCGGATGAAGGACAGAAGGCAGTCCCACAGCGCCCCCTGGTGC
TCGCTGCGGAACACGTGCGGCTGCAGCAGCTCCAGCAGGCCCAGCACGTG
CAGGAAGCAGCTCAGGTGGTTCTGCTGCCGGAACTCCT 1088. chr7_INTS1_NM_001080453_-1.59237
TGATGTTCTGCTCCAGAGTCTGGGGGTCGTGGGCCACTGCCTGGTCCAGG
AACTGGAGGAGTTTGCTCATGCTGGACACGGGGATGCCAAACGACTGCAC
GAACA 1089. chr7_MAD1L1_NM_003550_1.70242
TGAGGTGGGACTTCGAACGGATCTGCTCTGCTCTT 1090. chr7_NUDT1_NM_002452_-1.51489
GCTGCTGAACAGCCGCAAACCATCTTCACCTGGGGGCATTGAGTGGCGCA
GAGCCGGGTTTCATCTGGAATTAACTGGATGGAAGGGA 1091. chr7_EIF3B_NM_003751_-1.528
CGGCCTCCGGCCCGTCCGAGTCGCCCTCGCCGCCGGCCGCCGAGGAGCTG
CCCGGGTCGCATGCTGAGCCCCC 1092. chr7_C7orf27_NM_152743_-1.77414
GACAGCTGCCCCATGGCGGTCACTGCACTCGCTCGGACATAACTCTCAGG
GTCCT 1093. chr7_C7orf27_NM_152743_-1.71184
TGGGTCAGGAACTCGAGGGCGGAGTCC 1094. chr7_IQCE_NM_152558_-1.69843
TCCACAAACCTCCACCCACATCGCCAA 1095. chr7_TTYH3_NM_025250_-1.61972
GGCAGGCGCACGACAGCCTCTACCGCGTCCACATGCCCAGCCTGTACAGC
TGTGGCAGCAGCTACGGCAGTGAGACCAGCATCCCGGCCG 1096. chr7_RNF216L_NR_023384_-1.55587
ATATGGAAAATCTCACCAGCCAGGATGAGGTACCCAGAGATACC

Figure 3-90

1097. chr7_WIPI2_NM_015610_-1.74053
TACTTACGTGCCTTCATCCCCAACGAGACTT 1098. chr7_FSCN1_NM_003088_-1.58523
CCTGCCCACATGGCGGCTCCTGCCAACCCTCCCTGCTAACCCCTTCTCCG
CCAGGTGGGCTCCAGGGCGGGAGGCAAGCCCCCTTGCCTTTCAAACTGGA
AACCCCAGAGAAAACGGTGCCCCCACCTGTCGCCCCTATGGACTCCCCAC
TCTCCCCTCCGCCCGGGTTCCCTACTCCCCTCGGGTCAGCGGCTGCGGCC
TGGCCCTGGGAGGGATTTCAGATGCCCCTGCCCTCTTGTCTGCCACGGGG
CGAGTCTGGCACCTCTTTCTTCTGACCTCAGACGGCTCTGAGCCTTATTT
CTCTGGAAGCGGCTAAGGGACGGTTGGGGGCTGGGAGCCCTGGGCGTGTA
GTGTAACTGGAATCTTTTGCCTCTCCCAGCCACCTCCTCCCAGCCCCCCA
GGAGAGCTGGGCACATGTCCCAAGCCTGTCAGTGGCCCTCCCTGGTGCAC
TGTCCCCGAAACCCCTGCTTGGGAAGGGAAGCTGTCGGGTGGGCTAGGAC
TGACCCTTGTGGTGTTTT 1099. chr7_AIMP2_NM_006303_1.58641
GAGTCCCGCCAAGATGATATTTTAAAACGTCTGTATGAGTTGAAAGCTGC
AGTTGATGGCCTCTCCAAGATGATTCAAACACCAGATGCAGACTTGGATG
TAACCAACATAATCCAAGCGGATGAGCCCACGACTTTAACCACCAATGCG
CTGGACTTGAATTC 1100. chr7_ICA1_NM_004968_-1.90822
CTCTCTCTCTACTCCCCGGGGTCTCTCCTCGACCCCCATCTCCTGGGGTA
TCCCCCGCTCGGAT 1101. chr7_TMEM195_NM_001004320_-1.7536
GATGAACAGCATATACTGAAGGGGGTATG 1102. chr7_TMEM195_NM_001004320_-1.56531
AGGCACCTCTTCTAATGTTTGGAATGAAGTTTCACTGGGTTTCATCGTGT
AAAACAACATGCGAAATCCCTGGGAAAC 1103. chr7_SP4_NM_003112_1.61533
CTAATGCCACGATAGGTGCTGTTAGTCCTGACCAACTCACACAAGTGCAT
TTGCAGCAAGGCCAGCAGACTTCTGATCAAGAGGTACAACCTGGCAAGAG
GCTTCGAAGAGTTGCCTGTTCCTGTCCT 1104. chr7_C7orf30_AK127742_1.67959
CGTGCAGCGGCTTCCCGTAGGAGCAGCGTTCTGCCGGGGCTTGCCAGACCC
CAAACTTTGTCCGCGGCCTGCAC 1105. chr7_OSBPL3_NM_015550_1.55727
AGCCGCCGCCACAGTAGATGCTTTCATGCCATTTCCCAAACAGCCGATGA
ACCGCTTTTCCACTCCTGTCAAACACTGTGCCTTCAATCTCATGGG 1106. chr7_CYCS_NM_018947_-2.13251
CACAACGAACACTCCCGCTCCGAAGCCGGACGTCCCCACTCTCTAAGTCC
AAGGACACGCCGGTC 1107. chr7_HOXA1_NM_005522_1.67333
TTCCTGATTTAACGCGTAGGGGCTGTAAGGCGCACTGAAGT 1108. chr7_CHN2_NM_004067_-1.52699

Figure 3-91

GCAGCGACGCGAGGGGCGCGCGGA 1109. chr7_CCDC129_NM_194300_1.5327
ACCAACAGTGGCTGCGGGACTTTCCAGCACCTAGCCTGGGCATTCCCACA
GCCCAGAGGGAGCTCGTCCCAGACAACCAAGAGGAAAAGAAGGGAAACAA
GAAAGAGATGGAGACCCATCATTGTGGCCAACGACCCCACGAAGAGGGAA
TAGCGGTCCACGCACGGGACCCAGCCTCCGATCAAGCCCAGCAGGCGCCG
GGTGCGCCTGTGCTGGGAGGCAGAGCCCACGCCCACCCGGAACCGCGCCG
GCCAGCGAGGTCCGTGCGCAGCCCCGGCTGCCGCCTGCGCTTCTCCCTCC
ACACCTCACCGTTAGCAGAGGGAGCCGGCTCCGGCCTCAGCCAGCCCCAG
AGACAGGCCCCCACAGCACAGCGGCGGGCTGAAGGGCTCCTCGAGCGTGG
CCAGAGCAGACGCCGAGGCTAAGGAGGTGCCGAGAGACAGCGAGGGCTGC
TAGCACATTGTCACCTCTCAATACTGGAACTCAGAATAAGAGGTCTCCAC
TGTTCTGAGTTATGGGAGAAAGATGGGTGTATGGTAGACAGAATAGTGCC
TCCCCACAACAAAGATGTCAACATGTTACTGTGTGTGTTAAAAGGGACTT
TGTAGGTGTGAGTAAGTTGAAGATCTTGAGAAGAAAAGATTATCCTGGGT
TTTTTGGGTGGGGCCAATGTCATAAAAAGGTCCAGATAAGAAAGAGGCAG
AAGAGTCAGGGTCAGAGGAGGAGCCATCATGATAGGAGCAGAGAAGCAGA
GTCAGGAGAGTTGATGCTACACTGCTAACTTTGAAGATGAAGAAGCCACG
AGCTATGGAATGGAGACAGCCTCTGAAAGGCAAGGAGATGGATTTCCTTT
AGAGCTTCCAGGAAGGAGTGCAGGCCTGCTAACAGATACGTTT 1110. chr7_FKBP9_NM_007270_-1.5466
CTCCGACGCGGAGCTGCAGATCGAGCGGCGCTTCGTGCCCGACGAGTGCC
CGCGCACCGTGCGCAGCGGCGACTTCGTGCGCTACCACTACGTGGGGACG
TTC 1111. chr7_ELMO1_NM_014800_-1.57919
GGAGGTTAAAGGTGAGCACTTGTAGAACATACAGCTGGTGCGCCATCTCA
TTGTTGATGGCCCGCT 1112. chr7_ELMO1_NM_014800_-1.55517
TAGGCGCCCGGCCATTCTATGGCCACCTTGACGATGTCCGCGGGTGGC 1113. chr7_STARD3NL_NM_032016_-1.54067
TGTCTTCTCTTTAGGGATGGTGAGGTTGGAAAAAGGCTCCTGTAACCCTC
CTCCAG 1114. chr7_POU6F2_NM_007252_1.52788
TGTCTCAAAGTCCCGTCCGGCAGGCTTCCTCTTCTTCCTCCTCATCCTCC
TCTTCTTCAGCTTTGAGCGTGGGCCAGTTAGTCAGCA 1115. chr7_GLI3_NM_000168_-1.75086
ATCTGTAGGGCTCAGCCCACGGGTTGCTGAGATCATGGAGAGCGATGGGC
TGCTGTGCAAGGAGCGGATATAGTCCATGTAGGGATTAATGTAGGGATGT
GGAGGGCTGAAGGGAGACTCGGAAGCAGCAGTGGGGTTCCGGTGTGGGGA
GATCCTAATGAAGGGCAGGTCCGGATACGTAGGGCTACTAGATAAGGCGG
AAGT 1116. chr7_POLM_BC026306_-1.66942
GCTGCCCCTGTTTGCCTCCCCGTGCATGGTGTGGACTGTGTTGTCATTCC
CAGGGCAGGACATTCCTGGGGTAGGTCCGAGCCCTGC 1117. chr7_AEBP1_NM_001129_-1.62485
GGAAGGCCCCTGGTATGGACACTGA

Figure 3-92

1118. chr7_POLD2_NM_001127218_-1.64826
AGGAGGTTGCCAGCGAGGATAACCCGGGAGACGTGGGCGGCGCTGCA 1119. chr7_MYL7_NM_021223_-1.81949
TTTCTCGTCTCCATGGGTGATGATGTA 1120. chr7_CAMK2B_NM_001220_1.60826
CGTAGGCCTCAAAGTCACCGTTGTTGACGGCCTCGATGAGCTGCTCCGTG
GTCTTAATGATCTCCT 1121. chr7_CAMK2B_NM_001220_1.92361
CGGACGGGCTCGGCGTGCGCTCGGCTGCGCTC 1122. chr7_NPC1L1_NM_013389_1.52293
AGGAGACAGCGAAGGTGGGCACAAGGCAGAGGCTGAGCATGAAGAGCCCC
TCAGGGAGGATGGTCAGGTACTGCTCATAAAACACATTGGTGATC 1123. chr7_PPIA_NM_021130_1.70245
GGAGGCCAGGCTCGTGCCGTTTTGCAG 1124. chr7_PURB_NM_033224_1.53014
GAATTCGCTCTTGAGCGCGCGCCGCGGCCCGCCGCCCTCCTCGGCGCCAG
CCGCCAGCTGCTCGGGGCTGCTAGGGCCCAGCTGCGCGTAGTGTTCTATG
AAGTCGCCCAGCGAGTCGCGGAACTCGGCGGCCACCGCCATGGACAGCGT
GAGGCGGCTCTTGGAACCGCCC 1125. chr7_CCM2_NM_001029835_-1.59049
CAGCTCTGATGACCGGTCGGCACCCTCAGAGGGGGATGAGTGGGACCGCA
TGATCTCGGACATCAGCAGCGACATTGAGGCGCTG 1126. chr7_RAMP3_NM_005856_1.50339
CATCACCGGCATCCACAGGCAGTTCTTCTCCAACTGCACCGTGGACAGGG
TCCACTTGGAGGACCCCCCAGACGAGGTTCTCATCCCGCTGATCGTTATA
CCCGTCGTTCTGACTGTCGCCATG 1127. chr7_PKD1L1_NM_138295_-2.41038
TGGGGGTGCGAGGAATGCCAGGCG 1128. chr7_COBL_NM_015198_-1.63226
CACCCTCACGTGACCCATGCCCATGGTGGGGGGCTGGTTTCTCCCCTCCC
CTAGGGGGTTCCGGCCCTCATGGTGGGCAGACTTCTGCTGGGGCGATATT
GGCTTGGGGTCTGCTTG 1129. chr7_POM121L12_NM_182595_1.65797
TGATGCTTGGCCTTCCGTGCTGGTCCAGCCCGCCCCATCCGCCATCTGGG
ACTTCTGGGAGGCGACAACGCCTTCCTGCGGCAGCTGCAGTAGGGTCTCC
TTCGCCCTCGA 1130. chr7_EGFR_NM_005228_-1.65192
GAAGCCACGTGCAAGGACACCTGCCCCCCACTCATGCTCTACAACCCCAC
CACGTACCAGATGGATGTGAACCCCGAGGGCAAATACAGCTTTGGTGCCA
CCTGCGTGAAGA 1131. chr7_EGFR_NM_005228_-1.52259

Figure 3-93

CAGGCTTGGCCTGAAAACAGGACGGACCTCCATGCCTTTGAGAACCTAGA
AATCATACGCGGCAGGACCAAGCAACA 1132. chr7_PSPH_NM_004577_-1.50554
CCAGGGCCTCCACCGAACGCTCTCTTGAGA 1133. chr7_NCRNA00174_NR_026873_-2.17412
AGGGCCGCCGGAAAGCCGAAGGTGGGTCCGGGAGGCCTGAACGCAGGGAA
GCCTGGGGCCTACAACGGCTGCCAGGAGCTGGGCAGGAGCTGGGCCGAAC
GTGGTTGTCGTGAGGCAGGAGCTGGGCCCGTGGAGGTGGCCGGGAGAGCT
GGGCCTGGAGAGGCCGACGGGAACCAGTTCTGG 1134. chr7_STAG3L4_NM_022906_-1.57138
GGGTCACAAGGGAGATGTCCGCCCCCAGTCGTAGCCTCGGACGGTTTCTG
AGCG 1135. chr7_WBSCR17_NM_022479_1.56721
ACTTGATCGCGGTAGCCGGCTTCGTGCTCTTCCTGGCCAAGTGCCGGCCC
ATCGCGGTGCGCAGCGGAGACGCCTTCCACGAGATCCGGCCGCGCGCCGA
GGTGGCCAACCTCAGCGCGCACAGCGCCAGCCCCATCCAGGATGCGGTCC
TGAAGCGCCTGTCGCTGCTGGAGGACATCGTGTACCGGCAGCTGAAT 1136. chr7_WBSCR17_NM_022479_-1.8708
TGTGGACCTGGTACTGAGGAGCAAGACTGTCCAGTTCTCCTCCACATCTC
CCATCCCAGAATCAGGATCTGG 1137. chr7_CALN1_NM_031468_1.65283
AAGGCAGTAAGAACGGAAGCGGTGAGGGGTGCAGCTGAAGACCGCCAGGG
CTGCACCCCACTTAATGGCTTTCCCCTCATGCCTTGGGGGGGTCTCCACT
GGGTGGAGGAAGGAAGCCAGGGTGGGATGGAAAGCCCCCTCTTCTGTGGC
AACCCTGAAGTCAGCCTCTTGGAACTGAGGGTTGACCTCAGCA 1138. chr7_TBL2_ENST00000437521_-1.64046
AAGAACTCGGGGATGAGAAGTCAACATCTGTTGAGTCCTG 1139. chr7_STX1A_NM_004603_1.75168
GCGGAGCTCCTGGGTTCGGTCCTTCAT 1140. chr7_WBSCR28_AY372054_1.8162
GCAGTGGTGCCGGCTCAGCTCGTTGCAGCC 1141. chr7_ELN_NM_000501_-2.05716
CCCGGCTTTGGTGTCGGAGTCGGAG 1142. chr7_ELN_NM_000501_-1.50109
GCCGCTGGGCTCGGAGGACTCGGAGTCGGAGGGCTTGGAGTTCCA 1143. chr7_LAT2_NM_032464_-1.64253
CAAGCTGTTGCAATTCTACCCCAGCCTGGA 1144. chr7_CLIP2_NM_003388_-1.85244
AGCGAGCCCGGCTGCTCGTGGAGAGCGTGCGGAAAGAGAAGGTGG 1145. chr7_HIP1_NM_005338_1.59938
CTATTCTGGCCGTGGCAGTTTCAATAGCAGCTGAAGTGGCCGCCATCTCC

Figure 3-94

TTGTCCACCAGGTCCCCCAGCTCCTCCTGCTTGATGTCCAGTCCCCTGGG
CA 1146. chr7_POR_NM_000941_-1.56851
TCATCGTGTTCTACGGCTCCCAGACGGGGACTGCAGAGGAGTTTGCCAAC
CGCCTGTCCAAGGACGCCCACCGCTACGGGATGCGAGGCATGTCAGCGGA
CCCTGA 1147. chr7_YWHAG_NM_012479_1.65396
GCGGGCCACGTTCACAGATAGACAGATTCACCCGAAATGAGAATGAGGGC
CTTAAGGCTGCCGAAAACAAATGGGTGGAAATAGCAACGTTGTTTCCGTC
AATTCCAAATGTGCACTGGCTGCGTGAGACAAGCCAATCTCCAATTCCTA
TGCTTTTTTCATTAAAAAGAAAAAACTATCTCGAGAGGAAAAAGTTCTGG
TCAAATAGGAGTTCAGTGTTTGTTATCTGGTAACAGTTTTTTTATCTTCC
TACAATTACTTGGGGAAGGAGTGTCTTCGGGGAGGAAAAACTGACACACT
GACAAGGCTCCCGAAATTGGACAGAATGGTTAAGGATATAGCTCTTCCTT
TTGGGTTTTTCTACCAGTAGGCTTCTAGCACCTGAATTTTCACACACTGC
ACCACAGACCTTCTCCAAACGCCTCTCCGACCCCACAGCTTCTGCACCCA
GCTGCGTCCGCCAGCACGAGGCGCAGTAGGAAACGCCCCAGTGCAGAGTG
GGTGACGGCAGTGTGATCCCTGAGGAGGGAGCTGCAGCAGCTTCAGAAGC
GGGATGTTCTCTGAAAATACCAACACGATCCATGACATACAGACCTGAAT
TTTCTCTATTTTTGTGGCGTTTCACGTTTCTCTCAAGAGGATTAATAATT
TTGGTGGTGGATTTACGTTAAGAGGAAAGAAGGACCAAAAAAAAAAAATC
CCACAGCCACCTGACCTGAAGTCGCTTTCATTCTCATTTAGCCTAGGAGA
CCGATCAACAGCAAAACCAACCTGGATAAGGCTGAATAAGGATGTTAAAG
CCCAAACAACTAGCAAAGGAAAAGTACACAATCGATGGCTTGATGTTACA
TATGGCTGTAATGTAGAAATACTGTAAACTGCAATTTAGTGTTAATACTG
TCAACTAATCAGAGACTTCGGAAAACTGGCAAGGCCTAAACCATAAGGAT
GAATGAGACCTCAGGTTCTAAGTCTGTCAGTCTGGGATTTACACTGTTCC
ATGTCTGTAGGCTACACCCTGGAAAACATGCAGAGCCGAGACAGATGAGA
TAGAAAGTACCCAAAACGAGAGACGAGAGCGTATGTACATAAAAATCCTT
ACTGGAACCACAGAACTTACTGAATGAGGGCCATTCCTCTTTAAGTTTTC
TTTTCATCTGAAAACCCTATTATCTAGCAATAAGTTAAATTAGAGACAGA
CAGCTCCACTTGCATGAATCTACAGAACAGTCCAGACGCCAGTGTGAGGC
TGCTATTCCAATACCAGCACAGCTAGCCTGACTTTCCACTAGTGGTATTT
TGGCAAAAATGTCAAAGAGGCGATCAAAGACAGGACAGGTCGTGGGTTTC
TCCCTGGGAAGGTCATCCCTCCCTTTCCCTCCCCCACCCGACCCCCAACT
CATGGGAAAAAAATAAAGACTGCAGTAGTAGCATCCGCGTGCGCT 1148. chr7_ZP3_NM_001110354_1.50485
GTGGAGCCAGCCATCCTGAGACGTCCGTACAGCCCGTACTGGTGGAG 1149. chr7_UPK3B_NM_030570_1.50857
ACCCTGGGGGCAGCCTCACCTAGGGCTGCA 1150. chr7_MAGI2_NM_012301_-1.65325
AGTCCGACAGAGGGTACTGCCTGGTGTCGGGGGAGTGCTGCCTGTAGTCC
AGTAGGGGAGGCTGCCTGTAGTCCAAGGGTGGGGGCTGCTGGTAGTCCCC
TCCTGGGGGTTGCCTGTAATCCAGCGGGGGCTGCCTGTAGTCTGTGAATG
GAGGCTGTCGGATGTCTGGTTTCACATCTTGCCTTGCTTTCACTTC 1151. chr7_MAGI2_NM_012301_-1.81861
CTCCCCCGAGGATTCTGAAGCCAAA 1152. chr7_CROT_NM_001143935_-1.78193

Figure 3-95

TGCTGTGTCGAGGCCGAGCTTTTGTCTTTGAT 1153. chr7_ADAM22_NM_021723_1.53247
TGTGTGCCGAGAAGCAGTAAATGATTGTGATATTCGTGAAACGTGCTCAG
GAAAT 1154. chr7_KRIT1_NM_194456_-1.72614
CATTACAAAATGTGGTGGCTTGAGTAACA 1155. chr7_CDK6_NM_001259_-1.68359
ACTGAGGTTAGAGCCATCTGGAAA 1156. chr7_CCDC132_NM_017667_-2.53303
ATCAAATCTCTCATGACCCGACAG 1157. chr7_COL1A2_NM_000089_-1.72357
GGCTCCAAAGGAGAGAGCGGTAACAAGGGTGAGCCC 1158. chr7_SGCE_NM_001099401_1.61967
GTTGGGGACCCATATAGGACTCCATCACTATATGGTGTCCTTTGGATATA
TCGAAGCCATCCAGGTCGGTCTGGGTAACCCA 1159. chr7_DYNC1I1_NM_004411_1.59799
ATGTCTCCCTCCTCGAAATCAGTGAGCACTCCCAGTGAAGCTGGAAGCCA
AGACTCAGGCGATCTGGGGCCATT 1160. chr7_TECPR1_NM_015395_-1.53775
ACAAAATCCTTCATCGTTTTGGACCCATGG 1161. chr7_BAIAP2L1_NM_018842_1.87794
AGGTGCTCTCCGTGAGCCGGTTCACCTCCTCGG 1162. chr7_SMURF1_NM_020429_-1.66906
GGCGTCTGTAGTGAACCTCGCACATCAGGGTTTCGAAGCCGCTGTGCCTG
AAGTCTTTGATCTTGACTTGGGGACTCCACGAACCTGCAATTCCCTCCTC
CAGCAGCAGCACCGGTGCTATCTGTGTAAGGGGCTGGTTCCTCCATGAAG
CAGCTGAGCGGCCTCCCAGGCCCGGAGTCTTCATACACCGT 1163. chr7_ARPC1B_NM_005720_-1.50503
CCGTATTGTGACCTGCGGCACAGACCGCAACGCCTACGTGTGGACGCTGA
AGGGCCGCACATGGAAGCCCACGCTGGTCATCCTGCGGATCAACCGGGCT
GCCCGCTGCGTGCGCTGGGCCCCCAACGAGAACAAGTTTGCTGTGGGCAG
CGGCTCTCGTGTGATCTCCATCTGT 1164. chr7_PDAP1_NM_014891_1.56451
GCGCCTCGAACTGACACCGGAACCGGAAATAGCTTGGGCTCGACTTCTTC
CTCC 1165. chr7_ZNF789_NM_213603_-1.60546
TGAAAAAGCTAACTCCAAAACAGAAATTTTCTGAAGATTTAGAGTCATAT
AAGATATCAGTGGTAATGCAGGAATC 1166. chr7_ZKSCAN1_NM_003439_-1.68833
CCTCATGAGGGTAGTCCCAGAGACCAGGCGATGGCATCTGCACTATTCAC
AGCGGATTCC

Figure 3-96

1167. chr7_MCM7_NM_005916_1.65028
TGTTCATCTTCACAATCCGATGGG 1168. chr7_C7orf43_AK302342_-1.80484
CTCCACCAAGTCCCGGACAGCAGGGCTGCTGGGGCTGCTCTTGCGGGAGA
GGGGCCG 1169. chr7_GPC2_NM_152742_-1.58695
TCCAGCGAGGCGTCCGCTGCCATGCGAGAGTCTCCGCAC 1170. chr7_GPC2_NM_152742_1.50568
GTGTGAACCAGAAAGGAGCCGCTGTCCTCCACCAGGCCTCGGAAGGTGGC
CTCAGTCTCCCTGATCAGCCTCTGCTCTGTCTCACTGGAACAGCAGGTGT
ACTCCT 1171. chr7_PILRA_NM_013439_1.50731
CACAACCGGCCTCAGGGTCACACAGGGCAAACGACGCTCAGACTCTTGGC
ACATAAGTCTGGAGACTGCTGTGGGGGTGGCAGTGGCTGTCACTGTGCTC
GGAATCATGATTTTG 1172. chr7_MEPCE_NM_019606_-1.66063
GGAGGCTTCAAACATCCGGCCTTCAAGAGGCGCAGGCGGGTGAATTCGGA
CTGTGACTCTGTGTTACCCTCCAACTTCCTCCTGGGGGGCAATATCTTTG
ATCCCCTGAACC 1173. chr7_C7orf61_BC031966_-1.50713
TTGCCAAGCCCGTCTAACCCATCGGAAGA 1174. chr7_C7orf51_AK124773_1.68416
CCGCGAGCGTGACGGGAAGCTGCTGGAGGTGATCGAGCGCAAGCGCTGCG
TGTGCAAGGAGATCAAGGCGCGCCACCGCCCGGACCGAGGCCTCTGCAAG
CAGGAGAGCATGCCCATCCTCCCCAGCTGGCGGCGGGGACCCGAGCCCCG
CAAGTCCGGCACCCCGCCCTGCCGCCGGCAGCACACGGTCCTCTGGGACA
CCGCCATCTGA 1175. chr7_LRCH4_AK074175_-1.78956
CCCGAGCGCAGGACGGTACCGCCGTGTCC 1176. chr7_LRCH4_NM_002319_-1.51994
CGAACCCCTACAAATATAGATCCTCTCTACAAAATAGAGATAATTTAGCC
CCCCCATAGCAGCTGTTGGGGGGGGAAGGGGAGGGCACAGGAGGAAGGGG
GAGACTCCAGCTCCTGCCACCCCTCACGGGGTACAGAGGGCAGGGGCAGG
GCCGGCGGGGACATGAAGGCACCGTCAGCACTGAGAGGTGGGGACTCGTG
GGGCTACTGGAGGGAGGCCAGAGGCTGGGGGCCCAGGGTCTGGGGGCACC
AGAGTGGGGCCTCTGAGGTCAGTGTCTGTGAAGGGGGTGCACTAGTGTCT
TTGGTTGGGGCTGAAGGCACCGCAGGTGGGGTCGGGTGGAGCAGGGACCT
TATAAAT 1177. chr7_MOSPD3_NM_023948_1.56261
TTCTTGCTGACGGGGATTGTGTCTGTGGCCTTCCTGCTGCTCCCACTCCC
GGACGAACTCGGCAGCCAGCTGCCTCAAGTCCTGCACGTCTCCCTGGGAC
AAAAGTTGGTGGCCGCCTA 1178. chr7_GIGYF1_NM_022574_-1.72964

Figure 3-97

TGGGGGGTTTGAGCGCCTGGAGCTGCTGCAGGAATGCCGTGAGCTGCTGC
TGCTGCTGCTGTGGCGGCGGCGGTGGTGGCGGTGTCAGGTCCCCCAGAGC
TGCCTTTTCTCGGAGCGCGCACTGTGGGAGCTGGCGG 1179. chr7_ZAN_NM_003386_-1.76667
GACTTTGAAGACAACGCCCATCCCTTCTGTGACTGGGTCCAGACTTCCGG
GGATGGTGGACACTGGGCCCTCGGACATAAAAATGGACCCGTCCATGGCA
TGGG 1180. chr7_PLOD3_NM_001084_-1.618
CGGCCCCACGAGCTTCACAGCTGAGAAGTGGTCCTGGAGCTGCGGCCAGG
AGTCAGCGATGTGGGGTTCATGGAAGACCTC 1181. chr7_PLOD3_NM_001084_1.61252
AGAATTGAGGAAGCGCTTCCCCGTGCCCACCTCAGGGTACTGCTCCGCCA
GCCCCCACTCGGGCCAGCAGAAGCTCTCTGCAGAGAAGAGCAGGCGGCTG
CCACTCTGGACGAACTTCTTCAGCAGCTCTGTGGGGCTGCCGGCCAGAAT
CACGTCGTA 1182. chr7_ZNHIT1_NM_006349_1.74487
GGCCGAGGGCCCTAACTACCTGACGGCCTGTGCGGGACCCCCATCGCGGC
CCCAGCGCCCCTTCTGTGCTGTCTGTGGCTTCCCATCCCCCTACACCTGT
GTCAGCTGCGGTGCCCGGTACTGCACTGTGCGCTGT 1183. chr7_MYL10_NM_138403_-1.57381
CCTCCTCACTGAAGCGGTCTGCCTGGGTCATAAGTTTTTCTT 1184. chr7_CUX1_NM_181552_1.57071
TCCACTCCGTGACATCGCTCCAGGACCCGCTGCAG 1185. chr7_CUX1_NM_181552_-1.80284
AGCGCTTATTTGGGGAGACCATCTTAGGGCTCACCCAAGGCTCTGTCTCT
GACCTCCTTGCCCGCCCCAAACCCTGGCATAAGCTCAGTCTGAAAGGACG
AGAGCCCTTCGTC 1186. chr7_CUX1_NM_001913_-2.99357
GCCGCTGAGCACCGCCTGGAGAAG 1187. chr7_PRKRIP1_NM_024653_-1.93073
CAGCCGCCTCCTCGGTGCGACCACCGAGGCCCAAGAAAGAGCCGCAGACG
CTCGTCATCCCCAAGAATGCGGCGGAGGAGC 1188. chr7_RINT1_NM_021930_1.6504
GCTCTGAAAGTGGTGACGAAAGGAAGAACCTCGAGGAGA 1189. chr7_SYPL1_NM_006754_-1.72049
CTCAGTAACTGCAGGAGGACAATT 1190. chr7_FLJ36031_NM_175884_2.8759
CGGAACCGGCCGGCGCGCCTGGCC 1191. chr7_PRKAR2B_NM_002736_1.58201
CCGCCACCACACGGAGCAGACGCGCGCCGGGAGCCGCGGGCCGGGCCAGC
CGGGCCGCCGGGGCCCAGTGCGCCGCGCTCGCAGCCGGTAGCGCGCCAGC
GCCGTAGGCGCTCGCTCG

Figure 3-98

1192. chr7_PRKAR2B_NM_002736_-2.48921
CCGCGGACGCAGGGGCGTTCAATG 1193. chr7_TES_NM_015641_-1.75869
CGGAAGTTCGACGGCGCCGGGCGAGTGGCTGTTGAGCGGCGCCGCGGGAG
TTCCGCAGGTTTCCCGTGTTCGCAGCGGAGCCGGAGGCCAGCTGAACCCG
GCCGTGGGATCCCGGATAGGAGGAGGAG 1194. chr7_MET_NM_001127500_1.61943
TTCACTGCATATTCTCCCCACAGATAGAAGAGCCCAGCCA 1195. chr7_WNT2_NM_003391_-1.67728
CACACTTGGTCATCCGGGTGACATGGGAGGTGTCGTAGCCTCTCCCACAG
CACATGACTTCACAGCTGTCCATGCCCCGGGAAGTCAGGTTGCA 1196. chr7_CTTNBP2_NM_033427_-2.04154
GAGGCACCTGGTCTACAGGATGAGGCACTAACGGGGTTTATGGAAGAGCA
AAAGGCAATGGTGGTAGGAATGACAAGGGAACTGTCTGAACATGCAGGTT
GGTTCAGTCCGGG 1197. chr7_SLC13A1_NM_022444_1.89826
GGTCTCATTACTCATAGCAGGAGC 1198. chr7_GPR37_NM_005302_-1.65829
TAGCAGAAGCAGTAGCCGCGACATGCGGGCGAGAAGCGCGCCCCGG 1199. chr7_POT1_NM_015450_2.03955
TTAAGTTGATTCAGGGGTGTATATATAT 1200. chr7_FSCN3_NM_020369_-1.54745
GGGAAGTTCTCTCTGGGAACATCT 1201. chr7_MGC27345_ENST00000424840_-1.50258
AGTTTCCACCCCATTGACAGGCTTGGAGTCTTGAGTACCATCTGGGTGGG
TGGAGCTGGCACTGGCACGAAACCTC 1202. chr7_CCDC136_NM_022742_-1.50489
TCCTGGAGGATGAACGGCTAGCCAGCGCCCA 1203. chr7_KCP_NM_001135914_1.79989
GGCACATGCCTTGGGCTCGCAGCTCACGCTGCCCTCCCAGCAAAGGCAGA
GGTGGCAGGCAGCAGTGGGCGATGGGAAGCGCTCCCCGCTGGCAAA 1204. chr7_IRF5_NM_032643_2.22332
CCGAAGGCGTGGATGAAGCCGATCCGGCCAAGTGGAAGGCCAACCTGCGC
TGTGCCCTTAACAAGAGCCGGGACTTCCGCCTCATCTACGACGG 1205. chr7_TSPAN33_NM_178562_-1.63121
GATCGTGGTGGGTGTCCTCATGTTCCTGCTCACCTTCTGTGGCTGCATTG
GGTCCCTCCGCGAGAACATCTGCCTC 1206. chr7_SMO_NM_005631_1.57211
GGGCCCGGATTCTCTGGGCGCACAGGTCGCCTGAGCCGCCTCCG

Figure 3-99

1207. chr7_ZC3HC1_NM_016478_1.55138
CCCTCTTCCGGGGCAATCCCCTCAT 1208. chr7_CPA2_NM_001869_-1.61417
TCCTGTTGGACAAAGAGAATGAAGAAATGCTTTTTAATAGGAGAAGAGAA
CGGAGTGGTAACTTCAATTTTGGGGCCTACCATACCCTGGAAGA 1209. chr7_MKLN1_NM_013255_-2.56066
GGCGGCCGCTACGGTGCTGACAAG 1210. chr7_LRGUK_NM_144648_-1.70209
TACACAGACAGCACGAGGCAGCCCGGCAAGCTCTAATGGGAAGGATACGC
CCTGATCACACACTC 1211. chr7_SLC35B4_NM_032826_-1.86375
ATTTGCGTAGGGTCACGACGAGCGTGACGGTGAGGGAGGCGCATTCTGTG
GTGAGGATAAACACACCCCGG 1212. chr7_STRA8_NM_182489_-2.58319
TGAAGAAAACAGCAATCCCCATGAC 1213. chr7_CNOT4_NM_013316_-1.53901
TCTGGTGCTGTAGGCCAGTCACTGGATGTCTGTGGGGAGCTGGGGAAAGG
AGGAAGCCCACTTGGGATAGGGTTGGGATGGCGAAAATTGTCTGAGAATA
ACGACTGTGACTCTGTTACTGCCCCTTCAAAAGGGGACCGTGCACTGTGA
TTGGATGAA 1214. chr7_CREB3L2_NM_194071_1.56077
GCTGGTCTCATTCGAGATAATGAAATGGGGAAGATCCACATCCGGCCTGG
ACTCCAGCCCTGACACCCTGAGCAGGGAGGAACCTCTATCCCAGCCCCCC
AGCTCCCCAGCCGAGCCCGGGCTGGATGACTCCTCTGGGGGAGAATGTTC
CTCGTAGATCAGC 1215. chr7_TRIM24_NM_015905_-1.55129
AGTCATTCGTTGCCCAGTTTGCAGCCAAGAATGTGCAGAGAGACACATCA
TAGATAACTTTTTTGTGAAGGACACTACTGAGGTTCCCAGCAGTACAGTA
G 1216. chr7_KIAA1549_NM_020910_-1.50515
GGAAGTTCTGCACGGTGCTCTGTTTCTGGGAGAGCCGGAGGAGCTCCTCG
CGGATT 1217. chr7_ZC3HAV1_NM_020119_-1.65069
ATTGGCTGGCTTGGTGACAGAAGAAGGAGTGGAGAGGCGTCGGATGGGAA
AGGAATC 1218. chr7_TTC26_NM_024926_-1.7009
ACTCCAAAACCGCCTCCTCTTCCACT 1219. chr7_LUC7L2_NM_016019_1.51829
GCATCGCAGACATCGATCTCGCTCC 1220. chr7_ADCK2_NM_052853_-1.67616
CTTCTGAAAGCCACCGAGACCTCAGGCCCAACCTACATCAAACTGGGCCA
GTGGGCCAGCACCCGGCGCGATCTGTTTTCGGAGGCTTTCTGTGCCCAAT

Figure 3-100

TTTCCAAGCTGCATGTCCGAGTGACGCCCCACCCGTGGACTCACACTGAG
CGCTTCCTTCGGCAGGCTTTTGGGGATGACTGGGGGAGCATCCTCTCTTT
TGAGAACCGGGAACCTGTGGGCTCAGGCTGCGTGGCCCAGGTGTACAAAG
CATACGCCA 1221. chr7_NDUFB2_NM_004546_1.64234
TGTCCGCTCTGACTCGGCTGGCGTCTTTCGCTCGCGTTGGAGGCCGCCTT
TTCAGAAGCGGCTGCGCACGGACTGC 1222. chr7_BRAF_NM_004333_1.78599
TCCTTTCTCGCTGAGGTCCTGGAGATTTCTGTAAGGCTTTCACGTTAGTT
AGTGAGCCAGGTAATGAGGC 1223. chr7_EPHB6_NM_004445_1.72936
AAAGAACTGGAATAACCCCTTGCAGAA 1224. chr7_OR6W1P_NR_002140_-1.8289
ACAATGGAGAGGAAACCAACCACCCA 1225. chr7_CLCN1_NM_000083_-1.81741
GGGCAGAGCTCGCCCCACAAAGAAGAA 1226. chr7_CUL1_NM_003592_1.60429
GCGCCGTGTCGCACGCAGCTCCAGGCGGGGCAGCCCCGGTAGCTGAGGGA
CGCAGCTAGACCTTGGCGGGACGG 1227. chr7_EZH2_NM_004456_-1.62084
CATCAGCTCGTCTGAACCTCTTGAGCTGTCTCAGTCGCATGTACTCTGAT
TTTACACGCTTCCGCCAACAAA 1228. chr7_PDIA4_NM_004911_-1.56213
GGACCCTGGATCATGCCCCTTTGCCCCCAGCCCTTGGTTTGCAGGGAGGC
CGCCTGGCGATGCCCAGCCTGAAACAGCACCCCTGGCAGGGCTGCTCAGT
GGCAGCTCTCACTTTGTGCTCAACAGGAAGCAATCAGAAACACATACCAG
AAGCCAAATCTACGCCAACAATTTCTCAGACAACGAAAAAGCAAAGAGCA
AAATCAACATGATTTGGAAAAGGAATTTTAAACCTTAAATTAAAAAAAGA
AAACATTTTCACACAGAAGAATTATCTGCTTTGAGAAATAAAGAAATTAG
AAGGTGTAAAAAAAAATTTTTCAAACCCCAAATAATGATAAAAATAGATG
TATCCTCTGTAAAAATCTGGACTAAACTATTCAGTCATTCATGGTTATTC
AGTATTCAGAGCATGAAGTGAAACACCAAAGTATAAAAAATTAAAAAAAA
AAAAAAAGGAATCCGAGATACTGTCGTTTGTTGCCGGCC 1229. chr7_ZNF746_NM_001163474_-1.74959
CGGCCCGGCAGACGAAGGCCCGTGAGGCT 1230. chr7_ZNF767_NR_027788_1.75099
CCCGCGGCCCAGATAAAGTCGTCGCCGCTGCT 1231. chr7_SSPO_NM_198455_1.50714
CTGTATTCACCCTGGACTGTGCCAACCAGTGCCCACACAGCTGTGCCGAC
CTCTGGGACCGCGTTCA 1232. chr7_SSPO_AK124542_3.0903
CACCTCCAAAGTCAAGGCCCGGGA

Figure 3-101

1233. chr7_REPIN1_NM_013400_-1.68569
GGCCCGGTGGAGATGCCGTCGACCGCCCCTTCCAG 1234. chr7_GIMAP8_NM_175571_-1.64096
GAAGAGGGTCGCTCTCCGGCCATTCTCCCCTCACC 1235. chr7_ATG9B_NM_173681_-2.12454
TCTTGTTGTACTCGGCCCCAGAGG 1236. chr7_AGAP3_NM_031946_1.62752
CCCAGAAGGTAGTGGCCTTGCGAAAGAAGCAGCAACTGGCCATCGGGCCC
TGCAAGTCACTGCCCAACTCGCCCAGCCACTCGGCCGTGTCCGCCGCCTC
CATCCCGGCCGTGCACATCAA 1237. chr7_ABCF2_NM_007189_-1.70669
CAGGGATGGGCACTTCACGCTTCCCAATAGCAGAGAGCAGCA 1238. chr7_MLL3_NM_170606_1.55568
GAAAGGCAGCCGTTGCCTTCCGTCAGGAGCCCTATGTCTCAGTTCAATAT
ATGCTTGGCCCAGTATGTTGTGCTGCTGA 1239. chr7_ACTR3B_NM_020445_-1.8831
AGGACTATGAAGAGTACGGGCCCAGCATCTGCCGCCACAACCCCGTCTTT
GGAGTCATGT 1240. chr7_DPP6_NM_001936_1.88159
AGCGCTTCGGGGAAATCCGTGCAGCAGCA 1241. chr7_PAXIP1_NM_007349_1.57279
CCTGGACAGGCTCGAATCCAGTGAAAAGCACAAAAGGGGTCAATTCTGGA
GTTAGCTTTTTAGTGGGAGGTGGTACGTCTTCAAT 1242. chr7_NCAPG2_NM_017760_1.53218
GGTTTTTAATGGTCCCGTGGATCATTTTGATG 1243. chr8_DLGAP2_NM_004745_2.04934
TGGAAACGGCCACAGATTCTGACACGGAGAGCCGCGGTCTGCGGGAATAC
CACTCTGTCGGGGTGCAAGTG 1244. chr8_DLGAP2_NM_004745_-1.54735
GCCCGACAGACAACGCCAGGAAGCCCGGAGGCGCCTCATGGCCGCCAAGC
GAGCGGCGTCCTTCCGGCAGAATTCCGCCTCCGAGCGCGCGGACAGCATC
GAGA 1245. chr8_ARHGEF10_NM_014629_-1.66553
TAACCCGTTTAAAGGAGCACTATGAGAAAAAGATGAGAGATTTGATGGCA
AGCACGGTGGGCGTGGTGGAGATTCAGCAGCTCA 1246. chr8_CSMD1_NM_033225_1.76466
AGACAGGTTTGCTCGGATTCCACCTGCCGTCTTTGGTACAGCGAATAGTG
GCGGATGTGACTGCTTCCATGACATAGCCTGGGTTACACTGATAGCTCAC
AGTCTTGTTGAAGGTGAAGTCGGTCCCAAACTGGATGCCATTTGCTAGTG
TGCCTGGATCCCC 1247. chr8_CSMD1_NM_033225_1.50042

Figure 3-102

AGACATCGAGTTTCGCTGCCGCTCCAGAGCCCATTTGCCAAGCACTCTCT
GACATGAGACCCCACAAGCGTGTAGCCGGTGTTGCACGTAAATATAGCTG
TGGCCCCATAAACTGTCAACG 1248. chr8_ERI1_NM_153332_-1.50424
ATGGATTATGATGGGCGGCCTCACTGTGGTCTTGATGACTCTAAGAATAT
CGCCCGAATAGCAGTTCGAATGCTTCAGGATGGGTGTGAACTCCGAATCA
ACGAGAAAATGCATGCAGGACAGCTAATGAGTGTGTCCTCTTCCTTACCA
ATAGAGGGCACTCC 1249. chr8_TNKS_NM_003747_1.7731
CTGACGATATCAGAGCTTTGCTGA 1250. chr8_RP1L1_NM_178857_1.62139
GGCTGAGGCGTGTCCCTGGCCTCTTCCCCCAGGCTGGCAGCCCCAGATTT
TGAGCAGGAGTCGGATGTGTGGGGAGGTATGGGGGCCGGCGAGCATGTCC
TGGACCCCGCGT 1251. chr8_FAM167A_NM_053279_1.52782
GCTATAGCTTCATCGATGCTCTGAAAGCCTTCCAGCTTGCCAGTGGACAG
GGGTCTGGCACCTTGGCTGGCACTCCTGGCAGAAGGGGGGTGCTGCCCAG
CCTCTCTCAGGGGGAGCAAGGGCTCCTGCCCCCCACGCTCCCCCTCCTCC
AAGCTCGCCTGTGGCTCCGCAGCCGGCCTCGGGAAGGGCCAGGTATGCTC
CTCCAGCCTGGCCTGCCATTCCAGGTAGGAGGGCCTGCGGGTCTCCAGCC
TCAGTTTCTCGGTGAGGGCCTTCA 1252. chr8_NSAP11_AY176665_-1.79576
TCATCGCCATCTGTCCCACCGGACACCCC 1253. chr8_FGF17_NM_003867_-2.01784
TGCTGATTCTCTGCTGTCAAACTC 1254. chr8_FAM160B2_NM_022749_-1.54277
CACGAGGGGATCATCCACAGCCTGGTCCTGCGCAACCTTGAGGGCCGCCC
TTACGTGGCCTGGGGCTCA 1255. chr8_BMP1_NM_001199_-2.21043
GGCCGCTGGACTTGGCCGACTACACCTATGACCTGGCGGAGGAGGACGAC
TCGGAGCCCCTCAACTACAAAGACCCCTGCAAGG 1256. chr8_PDLIM2_NM_021630_-2.01836
GCCCGCCAGCGCTACTCCGCACCTGCCACCCT 1257. chr8_KIAA1967_NM_021174_-1.59886
CAAGAAACGCAAACAGCGGGCTGGTGGAGAGCCCTGGGGTGCTAAGAAGC
CAAGGCATGACCTGCCTCCTTACCGGGTCC 1258. chr8_KIAA1967_NM_021174_-1.56872
CCATAACCGTTTCTCAGCCACTGAAGTAACCAATAAGACGCTGGCGGCAG
AGATGCAGGAGCTGCGAGTCCGGCTGGCGGAGGCCGAGGAGACCGCCCGG
ACGGCGGAGCGACAGAAGAGCCAGC 1259. chr8_RHOBTB2_NM_001160036_-1.58793
GGCCGACTGGTGTCTCCACCACATCTGCACCAACTACAACAACGTGTGCC
GCAAGTTCCCCCGAGACATGAAGGCCATGT

Figure 3-103

1260. chr8_RHOBTB2_NM_001160036_1.71348
GCAGAATCGACTCCAATGCCTTTCAGGAAAGGACTCGGCACTTCTCTGAC
TGCGGAGGCCCTGACCCTGCCAGCTGGCTCCGAGGGCAACACAGGGGCCT
GGCCTCTAGAGGGCTGGTGATTGAGGGGCCCGGGCTGGCGGCAAAGAGGG
GTTTGGTCTCGGGGCTTAAATGGCACCAGACTCTTGCTTTTGCCCATCTG
GAGACTGCAGGCTCCCTTCCTTACCCTCAGAGAGTGCTTATGGTGGGTGT
TTTTGCGGGGCTGCAATAGGGGCCAAAAGTCAGGGAAAGGGGCACTGACC
TGTAGTGAAAGGCCACAGGACACAGCCTTATTACTGCTGGGGTGGGATAA
GGGGAAGGAGAAGAGGGAGAATGGAGCAGGAGGAAAAGCAGAGTTGGTCT
AGAGAGGAGGAGGGCGGGGCTGGAGGAATGTGGGGGATTGAAACTAGCTC
CCAGCCCCCATGGGGCAGCAGCTGGGCCACAATTGCCCCTTTCCGTTTTC
TAACCCCGACTCAGATTTCACCACCCACACTCTTTTTAGGTGTAAAAGAT
GGAGTCCCACGGAGGAGGGGCAGAGCCAGGAGGCAGTGGGGCTGTGGGCT
CAGAGCTCAGGAGTCGCCTTACCTGAGAGAGATGTTCTAGCTGAGAGGGC
CTGGCCCTGGGGTGGGCTCCAGGAAAACGCTGGTTAGGCCTGGGATTGAG
CTAACCTGAAACA 1261. chr8_TNFRSF10B_NM_003842_-1.78974
CTGTCCACACGCTCAGGGTCCCCAC 1262. chr8_TNFRSF10D_NM_003840_-1.55362
CGATGAAGACGACGAACTTAAGGATCTTGGGGTCCAGGAGCCATGGTCTG
GTTCCCGACGCTGTCCTGGCT 1263. chr8_CHMP7_NM_152272_-1.82523
TGTAAAGAAGAAGCCCGCCGGGCATGCCGAGCAGGAA 1264. chr8_LOXL2_NM_002318_-1.57966
AAGCCAAACATGCCGCAGACCACGCGGGAATTCTTGGCCGTCCAGTGCTT
GTCACAGATCTGCTTCCAGGTCTTGCCCTC 1265. chr8_SLC25A37_NM_016612_1.5047
AATCAGCTGCATCCGGACGGTGTGGAGGACCGAGGGGTTGGGGGCCTTCT
ACCGGAGCTACACCACGCAGCTGACCATGAACATCCCCTTCCAGTCCATC
CACTTCATCACCTATGAGTTCCTGCAGGAGCAGGTCAACCCCCACCGGAC
CTACAACCCGCAGTCCCACATCATCTCAGGCGGGCTGGCCGGGGCCCTCG
CCGCGGCCGCCACGACCCCCCTGGACGTCTGTAAGACCCTTCTGAACACT
CAGGAGAACGTGGCCCTCTCGCTGGCCAACATCAGCGGCCGGCTGTCGGG
TATGGCCAATGCCTTCCGGACGGTGTACCAGCTCAACGGCCTGGCCGGCT
ACTTCAAAGGCATCCAGGCGCGTGTCATCTACCAGA 1266. chr8_NEFL_NM_006158_-1.78799
TCGTTGGTGGCATCTTCCGCCGCCAGGCGCAGGTCGCGGAT 1267. chr8_DOCK5_NM_024940_-1.74757
TCTGGAGGTCACTCTGACCCCTGAAGTAGAGCTCCGGAAAGCC 1268. chr8_BNIP3L_NM_004331_1.54255
TTTGAAGAAAAGTGCGGACTGGGTATCAGACTGGTCCAGTAGACCCGAAA
ACATTCCAC 1269. chr8_DPYSL2_NM_001386_-1.53389
AAGTACTGAGTGTGATCCGGGATATTGGCGCCATAGCCCAAGTCCACGCA
GAAAATGGCGACATCATTGCAGA

Figure 3-104

1270. chr8_CLU_NM_001831_-1.57837
GTATGAATTCTGTTGGCGGGTGCTGGAAGGCCGGGCTATGGAAGTGGATG
TCCATGGCCTGCTGAGCCTCGTGTATCATCTCAAGGAA 1271. chr8_PBK_NM_018492_1.55944
TTCATTAGGTACACATTTACCCCAGTACCA 1272. chr8_ELP3_NM_018091_-1.85931
CCTGGTGGACCTGATTCTGATTTT 1273. chr8_PNOC_NM_006228_-1.63517
GGAAGGGGCGCTCCTCCCAGCTGTACCGGCCACTGCAACCCAT 1274. chr8_KIF13B_NM_015254_1.65326
TTGTTGCTGCCTAGACTGTATGATGGA 1275. chr8_PURG_NM_013357_1.87876
TAGGCCAGAGCCCCCTACATTCTTGCCTCCGCGGCCGCGGCCGCCGCCGC
CTCCCCTTCGCCTGGCTCTTTCCA 1276. chr8_GPR124_NM_032777_-1.52919
GCTGAGCGCCTTTCCCAGGGAGGTGGGGGGCGCCGGGGCAGGGCTGCACC
CCGTGGTATACCCCTGCACGGCCTTGCTGCTGCTCTGCCTCTTCGCCACC
ATCATCAC 1277. chr8_GPR124_NM_032777_1.55189
AGCCTTGGCGCCTTCTACATCCCTGTGGCTTTGATTCTGCTCATCACCTG
GATCTATTTCCTGTGCGCCGGGCTAC 1278. chr8_PPAPDC1B_NM_001102559_-1.93427
TCCTCCGGCTGGATGAGTCTCTGGAACGGGGGGAGCAGCTC 1279. chr8_WHSC1L1_NM_023034_1.50906
GCACTGCTGCACTCATCGCACTGATGCCACGGACACTCCCACTTTC 1280. chr8_TM2D2_NM_031940_1.67906
TTGCATGCACGTAATCAAAACGGGCAAAAGACATTTCTTCATCAAGTTTT
CTGGGGTTCGGTTTCACCCTGCTGACCCCTTTCCAAGCCAATTAAACTGA
AGCACAGCAGGTCAAACGGACAGCCACCAAAATG 1281. chr8_C8orf4_NM_020130_-1.7
GAGCTGAATTCCGGAAGATCCCCACATCG 1282. chr8_ANK1_NM_020476_-1.7657
GCACCACTTGGGTGAAGGTGTTCTTGGCCTCCTGCACCTGCTCTTCTTGG
CCTTGCTGCCTCCGGTCCCTGTCGGCCTGGGAGCTCTCAGCCTCGGGCTG
TTCTGTCCACGTGTGCTC 1283. chr8_IKBKB_NM_001556_1.53985
CCGGCGCCTTGTCTGCACACTGGAGGTCCTCCATTACAGAGGCCCAGCGC
ACATCGCTGGCCCCACAAACGTTCAGGGGTACAGCCA 1284. chr8_VDAC3_NM_001135694_1.589
TGGTTTCATAAGAGCCTGAGAGAG

Figure 3-105

1285. chr8_THAP1_NM_018105_1.51384
TCTCAGTGTCGCTGCGCTCGGTTGGATTCCCTCGCTTCTTTTGTAGCTTT
GGCCAACAGTTACAGTGATGGTGGCCTCCCTCGGGGGTGACTAGTGTGCC
CGTTTTGTTG 1286. chr8_SGK196_NM_032237_-1.60992
GTTTCCCGACCAGTCCCTGGGCGCCAACTAGAGTATGGACTGACCAGGTA
CCTG 1287. chr8_EFCAB1_NR_024605_1.73958
GGCACAGTTAGGTCGTGCCCTGATAAGGGGGTACACAAGGGGAACTCCAG
GCA 1288. chr8_TOX_NM_014729_-1.8937
CATAGTCCTGGCTCGGCTCTGTCAT 1289. chr8_ADHFE1_NM_144650_-2.04037
CCAGTGCCCAACTCATTCTCATAC 1290. chr8_ADHFE1_NM_144650_-1.58474
GCCAACTACCTCAGGAACCGGGAGTGAAACTACTGGGGTTGCCATTT 1291. chr8_STAU2_NM_001164380_1.54357
GAGTTTGATTTCTTGCAGTCCTGAGCGATGGAGCCCGGGGGTGCCTGGTT
ATTGTCCGCTTTCTCTCTCAGATG 1292. chr8_ZFHX4_NM_024721_1.81599
AACTGCCTCATTGGGAGCCAGGACTTGT 1293. chr8_TMEM55A_NM_018710_-1.6799
CGAGCCGGGGTTGCGGCCTCGGCGGAGTGGTGGCTACTGCTGCT 1294. chr8_RUNX1T1_NM_175634_1.98047
TTGACAATATTCAAAGTTCCCTTTTTTCCGGCAGTCACCTATTACTAA 1295. chr8_PTDSS1_NM_014754_-1.56407
CATTTGGAACTCCCCGTGAGGAGGTCGAGGCGCACAGGGCAAGCAGGAAG
AGGCGAGGGCACTTGGGGGTCATTATTTGA 1296. chr8_---_---_-1.56944
ACTCCAGCCGGGGTGACAAGAGCAAAACT 1297. chr8_C8orf47_NM_173549_1.52756
CCCTCAACAAGGCCGGCGACAGCAGCA 1298. chr8_POP1_NM_001145860_1.86993
CCCTCCTGCAAAACGGCCCAACTACGTTAAGCTTGGCACTCTGGCACCTT
TCTGCTGTCCCTGGGAGCAGTTAACTCAAGACTGG 1299. chr8_NIPAL2_NM_024759_-1.50873
AACGGAGCGATCAGAGTAATGGGAGCAAATCCATAGGCTGCAAAGTTCCC
CGTCTCTCCCACGGCCATCAGCAGGACACCACCCCACCACAGCACACTCT
TGAAGTATGGCCTTGGG

Figure 3-106

1300. chr8_VPS13B_NM_152564_-2.13266
AGGGGACGCGGCGGTACTCTGGCGT 1301. chr8_GRHL2_NM_024915_-1.85349
GGGAGGGCCCCATGACCTACCTCAACAAAGGACAGTTCTATGCCATAACA
CTCAGCGAGACCGGAGACAACAAATGCTTCCGACACCC 1302. chr8_UBR5_NM_015902_-1.53142
CGATCCCGTCCTGTCCGAATAACTCGAGTCTGCCGGCGGGAATCTCGAGC
TCCAGCTGATGACCTACCAGA 1303. chr8_KLF10_NM_005655_1.5094
GCGTCCTCGTGTGGGCCTTCAGATGGGAACTTTTAAAGTATGTCTTGCCA
CATCCTGGGTGGCTACAGATGTGACTCCTTATCCTTGATGAATCAATCTG
AGGAGTGAC 1304. chr8_SLC25A32_NM_030780_1.60763
CCCGCTATCAGGTTCTCATACCGGACGTGGCGGAATACCGT 1305. chr8_RIMS2_NM_001100117_-1.50307
TCATCGTCTGGGGAGATTATGGCCGCATGGATCACAAATCTTTTATGGGA
GTGGCCCAGATACTTTTAGATGAACTAGAGCTATCCA 1306. chr8_OXR1_NM_181354_1.59228
GCGGCAGCATGGACTACCTGACGACGTTCACCGAGAAGAGTGGGCGCCTT
CTGCGGGGCACGGCCAACCGCCTGTT 1307. chr8_EBAG9_NM_004215_1.62428
CTGAATTAGGTGACTTAGATACCTGGCAGGAAAA 1308. chr8_KCNV1_NM_014379_1.62704
GCCACAAAGTTGGGGACACGCCGGAAGCTTTGGTCCCGCGAG 1309. chr8_EXT1_NM_000127_-1.5776
CTGTCACAGCGAGAATCCTTGTGCTTTTGCCAGTCTTTGCCATGCTTGCA
GGTGGTGAGGAGCACAACGTCCTCCCCGTTATGGACGTGATATAAGGCAT
TCCTGGTGTCTGATCCTATC 1310. chr8_MTBP_NM_022045_1.63955
CCTTTTGACTTATTATCACTTCCACATTTTTCTGGGGAGCAGATTGTACA
GAGAGAGAAACAGTTAGCTAATGTTCAAGTTTTAGCTTTGGAAGAATGCC
TAA 1311. chr8_FBXO32_NM_058229_-1.79144
TGCTGAGGTCGCTCACGAAACTGCCGCTCTTCTCATCCAGGAAGCGCTTC
CAGCCGTCGGCCGTCTTCACCCAGTTCT 1312. chr8_RNF139_NM_007218_1.68566
AGCAGGTGCGGATGGCCCATCAGCAGGTCTGGGCGGCGCTCGAAGTGGCG
CTCCGGGTGCCCTGCCTTTACATCATCGACGCCATCTTCAACTCCTACCC
GGATTCCAGCCAAAGCCGGTTCTGCATCGTGCTCCAGATCTTCCT 1313. chr8_KIAA0196_NM_014846_-1.69519
AAAAAATGCAGTTGTATGAGCAACTGAGTTTCTTTTCATCTTCAAATTCA
TTTGTGATGGTGGGAAGATCTAAGGACAATCCTTCCATTGAAGAAGTAG

Figure 3-107

1314. chr8_FAM49B_BC016345_-1.70028
ATGGGGTACTTGTTAAGGCTCCCAGAAGA 1315. chr8_ADCY8_NM_001115_1.64372
TCTCTAGGAAATGGCGGGCCACATGGCTGGGTAAGATATTCCGGAGCATG
TTCTCATTGTGTTCCCTCAGCTCCTTCATCTCATTGATCTCCTCTTTGGC
CTGTACTCGCCAAAGGAAGTCCA 1316. chr8_PHF20L1_NM_016018_-1.56225
CTGGGCTTGTTCCGGGAAGCGAAAAGACCAAGATCAAATAATAGCTGGGG
TGGAGAAAAAAATAGCTCAAGACACAGTTAATCGAGAAGAAAAGAAATAT
GTACAGAACCATAAAGAACCACCTCGTT 1317. chr8_TG_NM_003235_-1.68953
TGAGGCCAGTCAGGACGGACTGGGATGCG 1318. chr8_COL22A1_NM_152888_-1.71332
TTTCCCGGGAAGCCGATCTCTCCAGGCAAAC 1319. chr8_COL22A1_NM_152888_1.72489
CCTTGCAAACCAGGAGGTCCATCCCT 1320. chr8_DENND3_NM_014957_-1.55187
AAGGGGAAAATCTACGTGATTGACGCCGAGAGGAAGACCGT 1321. chr8_ZNF696_NM_030895_-1.92377
CCAGCCGCTCTCGGGCGCGGCGTGGGGGAGGCGGCCCTGCAGGTGCGTAC
CCGGGGTCCGACACGTGCGGGGCTTCCTGCGAGCTGAGTCCCCGCTGC 1322. chr8_TOP1MT_NM_052963_-1.56057
GTCAGCCTGTCGAAGAGGTCGTCCCG 1323. chr8_RHPN1_NM_052924_1.56745
AGCCTGCTTGGGCCGCTCCTGCTGGCCTCCACAGGCCGTGAGCTGTCAGT
GTCT 1324. chr8_FAM83H_NM_198488_-1.65708
AGCGGAATGAGTCCTGCTTGGCCAGGCCAGGCTCCTCCGGGCCCTCGCGC
TCTGGGCCGTTGCCGCCGCTGCCCGGGCCTGGCACCGGGACCTTGGTGGG
GAAGGCTGCTGGGACGCGGAAGGCCGAGGGGAGCAGGTCGCCGGCAGGTG
CCCGGCCCCCGGGAGCCAGCACGTCGTCTTCGTAAGCCTCCGCTTCCATG
GGCGCCGGTAGGCCGTCGTCGCCCCCATCCTCGCCGTGGCAGCCGCTCAA
GTAGGAGGCCAAACGCCAG 1325. chr8_SCRIB_NM_182706_1.63388
AGCTTGTCACCCACACGGACTCCAGCCCGGGCCGCAGGGCCTTCCTCGGA
CACCCGAGAGAT 1326. chr8_NRBP2_NM_178564_1.62982
AGGCCTGGGTCCCACGGTACTTGAGGAAG 1327. chr8_PARP10_NM_032789_1.75828
CGAACGACGCGGATGCTGCTGCGGGCAGCGTCCAGGGTGTCGTAGAAGGC
CCGCACCA

Figure 3-108

1328. chr8_PARP10_NM_032789_1.70144
GGGCTCGTGGTGGAGCTGGCCGCAGGCTC 1329. chr8_SPATC1_NM_198572_1.68932
CCAGAGCCTCTCAGCATGGCGTTTGCAGGAGCACCCCTCCAGACCTCCAC
CCCTATCGGAGCCATGGGCACACCTGCTCCCAAGACGGCCTTCTCCTTCA
ACACTT 1330. chr8_OPLAH_NM_017570_1.71484
CCAGAACCGGGAGACTTAAGGCATCTT 1331. chr8_OPLAH_NM_017570_1.57903
GGCGAGCGGGCTGTGGCTGGGTGCTGGTGGGCAGACACCATCAGAGCACA
GTCCGTGCCCTGGTAGCGCAGGTGCA 1332. chr8_ADCK5_NM_174922_-1.6357
TCTCCACCGCGGTAGTGGGGGCGCCCCTGCTCCTCGGAGCCCGCTATGTC
ATGGCAGAGGCACGGGAGAAGAGGAGGATGCGGCTCGTGGTGGATGGCAT
GGGGCGCTTT 1333. chr8_SLC39A4_NM_017767_-1.55632
TCTCAACCCCTGGCGCCCTTCCGTCTCCCCAGGCCCCTGTCCTGCTTCCC
CAACTACAGGGGTGCACGCAGAGGGGTCCCCAACAGTGGTCCCCCATCCC
CAG 1334. chr8_VPS28_AK091979_-1.53688
GCTCGCGTGTCCACGGGTGCGGGAGGCCCCACGGCTCACGGGCCCCAACC
CCTCCTCAGCCACAGCTGTCACTTGGGCCTCCTCACTGTACTCTGTTCCC
AAACCCAGCAGGCCTCCTGGGTGAACGAGGTCCTGGCTGCCCAGACAGCT
GTGTGGGAACTGAAGGGTGGGCCCACACCCACACTCTCTCCCGAGGCCAG
GACCCCGCCAGAACGCACCCTGTGCTCATCCCCCCGACAGGAGTCCAGGT
GGCCTGGGGGCGTCCCCGCATGCTGCCCACCCCTCATTCCTAGTTAAAGG
GGTTCCCTTCTGCCCAGCAAGTCAGAGTGCTG 1335. chr8_FOXH1_NM_003923_-1.57342
CAGCTTCAGTCTGCGGGAGGGAGCGGCCTGAATCACCAAGGCGATCATGG
CCAAGTAGGTGTAGGGGGGCTTGTCATGTCGCAGGTACCTC 1336. chr9_DOCK8_NM_203447_1.56007
ACAGTTAATGAGGTCTACAAGCTGGTCATCCCCATCCTAGAAGCGCATCG
AGAATTCCGGAAGCTGACACTCACTCACAGCAAGCTGCAGAGAGCCTTCG
ACAGCATCG 1337. chr9_SMARCA2_NM_003070_-1.70788
GCCCCTAGATCTGACAGTGAAGAG 1338. chr9_JAK2_NM_004972_1.57025
ACATCCACCTCTTCTATATATCAG 1339. chr9_PTPRD_NM_002839_1.5227
TGGTGGAGGTTGCCAACTTACCAAAATACTAGTGGAACTTGGGCTGGTGC
AACTAATGTCTTGAGGAGGAG 1340. chr9_FREM1_NM_001177704_-1.54403

Figure 3-109

AAATGCAAGCTTGAGTGAGTGCCAGGGACTCCATCAGAGGCGGCCATCTT
G 1341. chr9_PSIP1_NM_021144_-1.69277
TGGGTAGTTTGTTTGTGGGTGGCTTTACAGCTCCATCA 1342. chr9_ADAMTSL1_NM_001040272_1.7928
ACCCAGGTGCGAATAGTCAGGTGCCAGGTGCT 1343. chr9_ADAMTSL1_NM_001040272_1.64742
GAGTCAGCCTGTGGACCCTGTGCACAGCTACCTGTGGCAACTACGGCTTC
CAGTCCCGGCGTGTGGAGTGTGTGCATGCCCGCACCAACAAGGCAGTGCC
TGAGCACCTGTGCTCCTGGGGGCCCCGGCCTGCCAACTGGCAGCGCTGCA
ACATCACC 1344. chr9_RRAGA_NM_006570_-2.47286
GGAGCGAGGCGCGGCCTGCGAGTC 1345. chr9_TMEM215_NM_212558_3.37937
TGGGACCACGAGACCATCGTCTAA 1346. chr9_NOL6_NM_022917_-1.84132
CTCACTTCGGGCCTCCACAGTCTGCACCAGGCCTTCACCCAGCACAGCAA
AGTCCTCCAGGATTGCTTCAACATTGGGCACCATTACTAGCTCCCCACCT
CGAGACATCACCATGCGCCCCTTTGTG 1347. chr9_ENHO_NM_198573_-1.56128
TGAGTTGAGCCTGGTGCGCGCCCGCGGGAGGGTCCGGGGCAGCGGGATGC
TCGGCGCCGACTAAGGCTTGG 1348. chr9_C9orf23_NM_148178_-1.77823
GAAGCCGCCTCACGCACGATCCGGAGCCAA 1349. chr9_SIGMAR1_NM_005866_-1.64136
AGACGACCTGGGTCAGCACCGCTGCGACAGCCAGGAGCAGCG 1350. chr9_FANCG_NM_004629_2.11481
CTCAGGTGTGGCCCGGAAGAGCAGCTCGA 1351. chr9_KIAA1539_BC004406_-1.98645
TGGATTATGAGGGGCCTCGGTCAC 1352. chr9_UNC13B_NM_006377_-1.65885
ACCCTGATAGTGCCGTCGATGACCGAGATAGTGACTATCGCAGTGAGACC
AGCAACAGCTTCCCACCTCCTTACCATACAGCTTCCCAGCCCAACGCTTC
TGTGCACCAGTTCCCTGTGCCGGTGCGATCGCCACAGCAGCTGCTACTTC
AAGGCAGTTCCCGGGACTCTTGTAATGACTCTATG 1353. chr9_CD72_NM_001782_-1.76267
AGGCCTCAGGTTAGGAAGGAGGGGCACAGGTTCTTGTTGGCATGAG 1354. chr9_C9orf100_NM_032818_-1.60631
TGAGGAGAGCAATGATTCTGTGAATTTTTGGGGAATTTGTGGCAGGAGGG
AGGAATGGGGACATAGGTTGGGAGCCACTGAGTGGACATTTCTT

Figure 3-110

1355. chr9_CA9_NM_001216_1.92745
CAGAGGTAGCCGAGACTGGAGCCTAG 1356. chr9_RGP1_NM_001080496_-1.8215
TCAGGATGTCCGGTTTCCCCAGGATGAG 1357. chr9_OR2S2_NM_019897_1.52425
AAAGCTGTCCAGGACCAGTGGGACTGAGGAGGTAGTGAAGCAGA 1358. chr9_GRHPR_NM_012203_1.71892
GAGACCGGTGCGACTCATGAAGGTGTTCGTCACCCGCAGGATACCCGCCG
AGG 1359. chr9_ANKRD18A_AK093059_-1.80455
AACATGGGGCAATTCCACGCAGGGTCCATGGAGGGAGCAGAAAGCAGCCG
CAATGAAGAGCCACGGTGG 1360. chr9_TJP2_NM_004817_-1.60228
CTCCGGCTTGGGAGTCAGATCTTCGTAAAGGAAATGACCCGAACGGGTCT
GGCAACTAAAGATGGCAACCT 1361. chr9_MAMDC2_NM_153267_1.53112
TGCAAGCTGAAATCACCTTTAAGAAGCCCATGCCTACC 1362. chr9_C9orf41_AK299691_1.58913
CGTAGTAGCGGAAGGCATTAATGAT 1363. chr9_GCNT1_NM_001097634_1.63333
TGAGGACGTTGCTGCGAAGGAGACTTTTTTCTTATCCCACCAAATACTAC
TTTATGGTTCTTGTTTTATCCCTAATCACCTTCTCC 1364. chr9_PRUNE2_NM_015225_-1.53974
CATTTCTTCATCCAGCCTAGCCCTGGCATCCTCCTTCTTGGGGTTGCACC
ATTCAAGTACACAATCATATAGTCTTCAGCTACCATCAAC 1365. chr9_FLJ46321_NM_001001670_1.53275
GATATTTCGCAGGCCATGAATCCCATTGATTCTTGTGCTCGTCATCACGG
ACCACCAATCCCATCTGCTTTACCACCGGAAGATTGCACTGTGACTCAGT
CTAAATCAAGTCTCACCATCTTGAAGACTTTTCCGGAAATGTTATCTCTA
GGTGGCTCTGGTGGGTCATCCACCTCTGCCCCAACAATCAAAGGCATTGA
CCATTCACACCTTGCATCTTCAGAATTCACCTGGTGGCAGCCTCATGCCA
AGGACTCTTTTTCCTCTAATTTTGTGCCATCTGATTTCATGGAGGAGCTT
CTTACCCTTCATTCTTCTGAGGCCTTTTTAGGGGGGCACTCTGTGGCCAA
CCTCATAGAGCCTGTTAACATCTCA 1366. chr9_---_---_1.67897
AGTTAACCACGTGTGCAGTCCGCGGCTTCTCAGAAAGAAGAGTACACACT
GTTATGATCTTTCTCTCCAGGCATGCCAGCCTGCATTTCATAGTTTGATT
GAAATTGTGCCATCCAGTCTGTCTCTTCACAAACAAATGGAATATTCTGA
GCTGCCAGCATTTGGAGGCGCACAGCTTGCATCTTTTTATGAAGAAAAAT
AAACACTGTGTATCGTAACAACCAAGTCATGATGGATAAAACATGCCTGC
GATCGAGAACCACTTGCACGGCCCACGCCACAGACTCGAGGCAGGTGGGG
AACGGCTGGACAGTGATGGAGAACAGGCTGCGGGCGGCTGGCCGAGAGAG
ATGAGTGGGAGCCGCGTGTGGACGTGCCATCAAGGAGAACTCTCTTTTCT
GGTTGCATCCCCGCCATTCCTGAAGAACACAGGCACGTGTTGTTTACTCC

Figure 3-111

ATTGGTGACAATTAGTGGTGGCGTCCGGTTCCCTTTGTGCTTCCAGTCAT
TACTCAAATGCTTCAAACTTGTCCCATCTCCTGGACATCCTTAGGTTGTT
TTGTGGACTAGAAAGAATTTCAAACCACTCACATGTGATTTGCCAACTCA
TTCCTTTGGACAACTGCTTTTCATAGCCCCAAAGTCCTGGAGCAGTGGTG
CTCAGGGTGTGGTCCCTGGGAGCATCAGCATCAGCATCAGCATCCGTCAG
GGAACTTGGGAAAAATGAAAATGCTTAGGCCCAGCCCCAGAGCTGCTAAA
GGGGGATGGGCAAAGGACAAAGGGCAAAGAGCTCACGTCAAGTGAATTTA
CACCCATTTACACACTTTCTAGAAGTTTCATCCAGTGAGGTCTACTTAGG
TCTCTTTGGCCGGAACGGTGTCATATGGCCGCTACTCACTGCAAGGAAGA
CTAGGGAACAGAGCTTTTGAGTTGGGCCCGTTA 1367. chr9_CTSL1_NM_001912_-1.93405
CAGCCCTGGCAACGAGAGCGTCTACCCCGAACTCTG 1368. chr9_CDK20_NM_178432_-1.50642
GGTGCCCAAGATGCGAAGCACATAGCAAAGCTGTTCAATATCGTTCTTGC
CCGGGAAAAG 1369. chr9_SPIN1_NM_006717_-1.5592
TGTATCTTATAAAATACGATGGATTTGACTGTGTTTATGGACTAGAACTT
AATAAAGATGAAAGAGTTTCTGCGCTTGAAGTCCTCCCTGA 1370. chr9_SHC3_NM_016848_-1.63067
TCAGTCTAGTATCAAGAAAGCCCCCTGGAGGAGGCATCTTGCTTGGGATG
CTGTTGTAGTATGGGTGGTCTGAGCCATCTCCCTCCTCTTCCGTCCATGG
CTCATCCAG 1371. chr9_SHC3_NM_016848_1.92669
CCCTCCGTGGGCTCGCTGCATCCGCCCG 1372. chr9_AUH_NM_001698_-1.55344
GCCCTGGGCCCAGATCGCCGGGCCCGCTCGC 1373. chr9_NOL8_NR_024020_1.51523
ATTAGTTACTCAGGATAGAGGGCAAAGAGATTATATACAAAAAGTATTTT
CAAGGACTATCTTGTTCTTCCTTTATAAGAAGTTGAATTTAATTTTTGAA
GTAATTACTTAGGAAGAAATGCAGAGGAGTTCCACAGAAAAAGATGGCAA
CCAGAATGATATTCCGTCAGCCAGATTTTTAAAATTCCTTCACTCTGAAA
TTTCTTCTTTGTCAGCTAAAACTGTTTTCTGGGTCAGTTTCCTTAGGTGA
GCCTTGTTCACATTCAGTATCAAAACCAGC 1374. chr9_NOL8_NR_024020_-1.68577
TGATTTAGAAGGAGTAATGGAATCACAAGTTCTTTTTTGTGCAGCCTGTT
GCTGTGTTAAGGGTGGTCTCTCTATTACCCTCCTGGGCCTTGTACTCATG
GCCAGAGACCCAGTGGAACTCTCATCCTTCTGCACTTTTATTATCTTCTT
GGGAGGGCCATGAAAGTCAGAGAACTCTCCTCGCCGTTTCTTACT 1375. chr9_ECM2_NM_001393_1.69215
GTAGGACAGAGAGCACCCGCTTGGCAGGCGCA 1376. chr9_C9orf89_AK128259_1.74118
TCCATCTCCGCCTCAGGGGCTTCTCCACCCCAAGTCTGGCTCCATTCCTG
GCCTTCTGTTGGTGACAGACCCCCCCCCTAAGGTGCTCGTTTGGGGGCTC
TTCAGGCAGCACCTCAGCCTGGCACCCCCACTCCCCTGCGCAGCCCCCAG
GCCTCAGGACCCCACCCCTCTGAGGCCCAGGGGAGCCCTGTTCACGCTGG

Figure 3-112

TTTCTC 1377. chr9_BARX1_NM_021570_-1.55327
TGTCCGGCGTGGAAAGGTACTTCTGCTTCTCGAAGCGTTTCTCCAGGCC 1378. chr9_FBP2_NM_003837_-1.57747
CTCCCGGCAGGAAACCTTGCTTACTTCTGA 1379. chr9_HSD17B3_NM_000197_-1.78964
GAAGGCACCGCTGTAGAAGGCCCAGGCCGGGATCAGGCTCAGAAAGCCCG
C 1380. chr9_TDRD7_NM_014290_-1.53238
CAAAGACTATTCTGCTGCTCAGGAATTAATGGAAGATGAGATGAAGGAAT
ATTACAGTAAGAATCCTAAGATCACACCAGTCCAGGCTGTGAATGTTGGG
CAGTTGCTGGCCGTAAATGCCGAGGAGGACGCCTGGTTAC 1381. chr9_TMOD1_NM_003275_-1.61068
CATTCCCAAGTGCCGGAGTGGTGTCTAG 1382. chr9_FOXE1_NM_004473_3.92692
TGACTGCCGAGAGCGGGCCGCCGC 1383. chr9_NANS_NM_018946_-1.66161
ACCCGTGCTTCATCATTGCCGAGATCGGCCAGAACCACCAGGGCGACCTG
GACGTAGCCAAGCGCATGATCCGCATGGCCAAG 1384. chr9_TBC1D2_NM_018421_-1.54554
GGTGCTGGCGTCAGAGGCCAAGGGCTGCTCCTCCCTCTGAGGCTCCCCAC
TCTGTGGAGAATCTTCCCCTGGAGGTTCATGGCCTGTTCCCTGGGCCTGC
TTGTTGCCACGGATGTTGTGCATT 1385. chr9_COL15A1_NM_001855_-1.70625
AACCTGGAATGCATGGAGCCCCAGGA 1386. chr9_TGFBR1_NM_004612_-1.74065
TGGAGGCGGCGGTCGCTGCTCCGCGTCCCC 1387. chr9_STX17_NM_017919_-1.50995
GTGCTGTCCCTCCCTTGTAATTATGAAAAGTTCTTTGGTTTCTGGGGTGA
ATTCTACCCATGTATAATGAGGAATTCTCTCATAACCTTTTTTGTCTTGT
CTGTCATCTCTGTTCATCCCTTCCTATAACCTCTAGGTAAAAAGAAAAGA
AAAAAAGAAATTTCGAGATATTTTCAACATTGTTAGAGTTTGGGCTAAAA
TGAGCAAGGAGAAAAAAACCACCAAGAACATTTCCTGGGGCATGTTCCAG
TTTTGAGGGGTGATATATCTGCCAGATAGGGGGTATCTGACCCAGTCTTC
TTTTCAGCTGGTCTCTGGGGGGAGCTGAGAACTCGCTTGCTACCTCACAT
CCTTTTCCCCAGACTTTTTATCTCCTATGCATCCCTTTGCTTTCTATAGC
TGGTGTTTCTTCCCCAAAATGGCGTTCCCATGCTTACCTTTCTCACATTC
TAGACAATGATGGACAAAGACGCATGCAAGACTCAGACCCGGGGAATGGT
GTGGTGCTAATCTCAACACCTGACATTCACAGCAAGCATGGCCCAGCCCA
ACTGCATGTCTA 1388. chr9_C9orf5_NM_032012_1.53733
GGAGGTGGACAACGTTGGAGCGGATTCTCCCCTGTC

Figure 3-113

1389. chr9_PTPN3_NM_002829_1.50999
GGCCAACCCTCCAGAAGCTGGGTTTCCCATGGTTCAATTACTAGAAGCTC
TTTTCTCAGAAGGCCAAACATTCGGAATATTTAGATGACACTGTCCCATC
TCCCCTTGGGAAAATCATAAGGTTTCAAGTGGAGGAGCTTGAAGTAGCAG
CAATACATGTAGGAGATTCAGTAGTCGGTGATTCCAGTCC 1390. chr9_PTPN3_NM_002829_-1.60776
TTCACGTAACTTGCATTAATATAATCTTCATTTCCCTGCAATAATACCCG
GGTGGTGTCAT 1391. chr9_AKAP2_NM_001004065_1.6374
CTCTCTGGGCGATGAAGGACAATGGTGGTAGGGCCACTTAGAGAGCAGTA
GGGCCCAGGCTGGTGCAGCCTACATGGCACAGGATATTTCCCTGCACCAG
TTTCCCACCTGTCACTTGCAGCATCAGAGGGTGTTGCATTAACTCCATTT
TCTCCAGCAGCCATAAAATGAATGGCGTTTCTCTCCATATTTGCCCAGAA
GAGGCAGTTATGATTCCACTTCTCCTACATTTAATTATTTTTAATTGAGA
ACAACTCATGATCACAATTCATAAAATCCATATTTTAAGACAATAGTTCT
TCATGTCACAAACACAATCTATTCTACATGAGGAGGCTGAGAAAGGGGAA
GAGAAAAACAAACCAAATGGATGATGTTAGCTTTAGGATCGTGTCTGCTT
ATAATATTCACTGATCTGCAGTTTATGAGAACACATTTTCACAGTTATGT
TTCTTCATAGGAAAACTATATTTAGTGGGCAACAACTATTTTTATGATGG
GATGGGGGAGTATATACACGTATAGAATCTGTACGCGTTGAACAACTTGG
TTCAAGATGGTGGGGGCATTTTTAGAGCGGCAATAATTGAAAAAAAAGGC
GAACTCTGCCTTGGAGAGGTAGATGATAAGAAATAAAAAGGTGTTTATAA
CTATTTTGTATTATAAAGTGGGCCTTAGAGATAGGAAGAAGAATGATGGA
TTCCTTTTGGATCAATCAGAAAGGAAACACGAAAGAAAAGTCAGGAAGGT
AGAGAGAGAAAAAGGGAGGGAAGGAGAAAGAATGGGAATAAAATAAGGAG
GTAAGAGATACTATTTTTGCTGAGCAACCAGTGTGTTTCAGGATGATACA
AAGAAAAATATAGAATAGAAATAAGTGCAGGCTTGGAATCAGCTACAAAT
CCTAAAGATGGGGTGTGTGTGGATGTGTGTGTGTGTGTGTGTACACCATT
GTGTGTTTGTAAAATGTGTATGTTCATGAGTAAGGGTGTGTGTGTGTGTG
TATTAAAATTCCAGAGTGACCGTGGCACTTGGGTGTACAGGTAATTCCTC
CAGAGCTGTTTGCTGGCTTCAGGAGTGGAGTGAGAATTTCTTTTTTATGA
AAAGGGATATAAAGGCACCGAGCTGATGCAGTATTTGTA 1392. chr9_ZNF483_NM_133464_-1.53398
TGTTACTCAGAAGTAGCTGGACCCAGGAAAGCTCTGAGTCAACTCTGGGA
GCTCTGCAATCAGTGGCTGAGACCAGACATTCACACGAAAGAACAGATTT
TAGAGCTTCTGGTGTTTGAGCAGTTCCTGACCATTTTGCCTGGGGAGATC
AGGATTTGGGTAAAGTCACA 1393. chr9_DNAJC25-GNG10_NM_004125_1.50013
TGGGGGCGCCGCTGCTCTCTCCCGGCT 1394. chr9_SUSD1_NM_022486_1.88348
TCCATATCAGCTGTCTTGATGCTTC 1395. chr9_SLC46A2_NM_033051_-1.63407
GGCCAGTGGCGAGCAGAGCCAGGG 1396. chr9_RNF183_NM_145051_-1.68711
CTGAGGTGGGCCAGACATTCCACGCAGAAGGAGTGGCAGCAATCCAGCAT
TTTGGGGGTATGGAACGTGTTGTTGAAGGGGTTCCAGCAGACGGGGCACT
CAGCCTCAAG

Figure 3-114

1397. chr9_RGS3_NM_130795_-1.59839
CTGCAAGGTGTGCTCGGAGCGCCGCTACCGC 1398. chr9_FLJ31713_AK056275_-1.50636
CAGAATCCTTTGCTGGCCGGAAGAGTTCACCATATTGGTGAACCTCAGTA
TCATGGCCTTTCACCATCTTCCTGTTCCCACGTGGCAACCAAGGGAGGGA
ATGTGGTCTCCCTCCCTCCCTGATGGCCAGCGCCCCCTGCCCTCCAACCA
CGGCCAGCCCCACAAGGTGAAGGGCCCCAGGGCAGACACTTGGAGGTAAA
CGGAGGTGGCAGTCCGTAGTTGCCTCAGACCAGGGAGCCCAGAGGAGAGG
CTGAGAGAGGGCCTGCTACAGCTGCCAAGGGTGGTTGGGGACCCCTGAAA
AATTAGAAGGGGCCCCGCAAGGTCAGACCAGCTAAAAGTCCTTACGTGGT
AAGCATATGTACATTGCAGGCCTGCTGCTTCCTGGACCAACTCTTCCATG
GCCCTGGGTGTCACCCAGTGTTTCTGGAGCCTCTGAGTGGTGCCCGCTGC
CTGGCAGCAGCCCCTGGAGGTAGGCACTTCCTGGCATCATGGCAGATCTG
GCATCCTCT 1399. chr9_COL27A1_NM_032888_2.89049
GGGCTCTCCGGGAATCCAGGACCT 1400. chr9_COL27A1_NM_032888_1.72379
AAAATCAGGGAAGCAAGGCGAGAAGGGCCGCACTGGAGCC 1401. chr9_AKNA_NM_030767_-1.76262
CATCCTGGGTCCTAATGGGCCGGCAGTGGGGACAGGAGACTGTGCCATTG
CCTTTTGGGACCGCCTTAGGGGACAGAACATGGTATTCGTGGC 1402. chr9_TNC_NM_002160_-1.62625
CCGTTTGCGCCTGCCTTCAAGATTTCTGAAGTTGCTTGGTCTCAGCTTCA
TCTCAGCAAACTGGATTGAGTGTTCGTGGCCCTTCCAGTGGAACCAGTTA
A 1403. chr9_TNC_NM_002160_-1.65092
ACCCCGCGGATGGTGATGGTATAATGAGTGGCTGCTTTGAGCCCAGGCAG
GTCTGTGGACCTCAGTCCTCCTGGGACGGTGAGGTTCTGGGCTGCCTCTA
CTGTGTCAGCCTCCTGCACCTGAATGAAAAAGTACTCATAGGCCCCTTC 1404. chr9_TLR4_NM_138554_1.82936
CTGGACCTGAGCTTTAATCCCCTGAGGCATTTAGGCAGCTATAGCTTCTT
CAGTTTCCC 1405. chr9_CDK5RAP2_NM_018249_-2.98263
ACCCAGCATTGGGGTTGATGCCAT 1406. chr9_ARPC5L_NM_030978_-2.28225
GGAACACGCTGTCCTCGCGCTTCC 1407. chr9_SCAI_NM_173690_1.69087
GTTTTCGAGGCGGTTTCTCCACTGTG 1408. chr9_RABEPK_NM_005833_-1.58337
TGGAAATCCTCCATCTCCCCGGCATGGTCATGTGATGGTGGCAGCAGGGA
CAAAGCTCTTCATCCACGGAGGCTTGGCGGGGGACAGATTCTATGATGAC
CTCCACTGCATTGATATAA 1409. chr9_GARNL3_NM_032293_-1.76703

Figure 3-115

GCTGATGGAGCCATCCAAAGGGCTGGAAGATTCAGAGTGGAAAATGGCTC
TTCA 1410. chr9_GARNL3_NM_032293_1.96339
TGACCTTCCATCAGTGCCCGTGTTTGACAGAACT 1411. chr9_LRSAM1_NM_001005373_1.539
ACCGCGGTGCGCTGAAGCTAGAGATTCCGAAAGGGGGTTCGGGTAGTTCG
CTCCGGAGAAGTCTGAGAAGGGTGGCTCCGGTGATCCCAGCCCTAGCTGT
TTC 1412. chr9_ENG_NM_001114753_-1.60735
GGACCCTCAGGATGTGCGCCTCCTTGTGGCCGGCCACGCCTTCCAAGTGG
CAGCCCCGGACCAAGGCTGGAGTACGCGGCCGCCACTCGAGCGTGCGGCC
CATGTCCTGG 1413. chr9_PTGES2_NM_025072_-1.56721
CTGAGCGCTCTGCGTGGAGGTCCTGGGCGCGCAGGTGCCACCGCGCCGTG
TGGTACAGCCCCA 1414. chr9_LCN2_NM_005564_-1.61881
TGACTACTGGATCAGGACTTTTGTTCCAGGTTGCCAGCCCGGCGAGTTCA
CGCTGGGCAACA 1415. chr9_CIZ1_NM_012127_1.58777
TTTGAGGCGGGTTGAGCGCCGAGGTAGTGGGGGCTGGGAGGGTCGAGCCG
TCACCTTGCTGGGTGTTTTGTCCTGGGTGTTGGGCTGGGAGGGTGGGCGG
CCGCTGGAGGTGAACAGGGCTGTCAAAGCGTTCCGGGCGTTGA 1416. chr9_SLC27A4_NM_005094_1.5855
GGCTTGCCGGCTTCGGGGAAGGTGCGGCAGGCGGTGCTGCGGCCTGGCAC
AGCAGGTTTGGGGTGCGGGAGGCGGGCGGGGTAGGAGCGCGGCGGGCGGG
GCCGGGCGGCGGGCGGGGCTGGCGGGGCGGCCGGGCCATGCAGGGCGCAG
AGCCGGCTAAACCCTGCTGAGACCCGGCTCCGTGCGTCCAGGGGCGGCTA 1417. chr9_URM1_NM_030914_1.53329
GCTGCTTACAGCTCATTCTGCTGGGGGTAGAGATGAGGGGAGGGAGTAAG
TTAAACCTTGGACTAGCAAGTAGAAGCCTGGGGGGATGCGTGTGCCTCAG
TTTCCTCCTCCACAACTGAATATAGTGGCTGAAAACTGGGGAGATACTTG
ATGGCGCGAATGTCCGTTTTCTCTCCCTTCCCACCTCCTGCAGGAAGCAG
GACGGGGCAGGCAGCACCTGGTAGGCACAGTGCTTTGCCCCTCCTCCCCT
TCCCTTCTGGAAGTCTTGGGGCCTCAGTGCTTGCAACAGCCGGCCTTGGG
CAAATAA 1418. chr9_ODF2_NM_002540_-1.51442
AAACAAATGACCTGCACGGACATCAACACCCTGACAAGGCAGAAGGAACT
TCTCCTGCAGAAGCTGAGCACATTTGAGGAGACCAACCGCACCCTCCGAG
ACCTCCTGAGGGAACAG 1419. chr9_GLE1_NM_001003722_-2.47657
CTCCCCTGCAACACCAAATGGAAC 1420. chr9_SPTAN1_NM_001130438_-1.9208
TGTGCTCTCACTTTCCACTGTAACCTTAAGCCTGCTTAGCTTGGAATAAG
ACTTAGGAGAAAATGGTGCTTCACTAACCCGCTTCCGGTCCAGTCACAAT

Figure 3-116

CATCATGTCACTGTGGGGACCCAGATCTGTGTCTTGAAGCAGCTGCCCTC
ATTCCGACTTCAGAAA 1421. chr9_FAM73B_AK301241_-1.66768
TGAGCTATGCCCTGCGGCCCGAGACCTGGGCCACAACACGGCTGGAGCTG 1422. chr9_TOR1B_NM_014506_-1.52893
GCCCGCCGAGCACTCTTGATCTGAGCTGACCTGTGTGTGTGTGTGTGGGG
GGGTGGGGCCTTCACCTAAGACCTCTGCAGCAGACCTGGACAGACAGGCC
CCTCCCGCCTGTCCATCGCTCTAGCTGCTAATACAGCCCTGGCTGTGGAA
TCCTTCACCGTCTCAGCTGGTATCAGCCCCAGCCTGCCTTGTGCCATATC
TCAGCTTGGATCTCTGCTAGAGTCCCCCCAACCATATATCATAGAGTTGA
ATCACAATGAGACCGTTGGCTTTGAATTTGAGTCGTTGGTTCCCATGGTG
AGATGCTTGTTAAGACTTTATACTTGGGTCAATCTCTCACTTTATTTTGT
AGAACCATTTGAAATCCTAGGATGTGCTTGTTCTGGAAGGATGACATGGG
CCCAGACTGAACAAGTCAGCTTGATGATCTTAAATGATGGAAGTATAGGA
CGTTGCTTATTTTAAAACAAGGGAAGGACACAAAATGGAATGACTGCTTA
GTCCTTTCTCAGATACTCTTAAAACAATTTTTTATTGTTAAATTTGTGGT
AATACATGGTCACAACCGTGGATCAAACAAGGTCAGTCTAAAGTGGCAGG
TCCTAGGTGTGACCTGATACCACCACCCTTTGTGGCAGCACCGGGCTGGA
CTGCCCTGATCCCTGGGACGTGAGACTTAGCTT 1423. chr9_USP20_NM_006676_-2.42163
TTTGCCCTCACCTTGACTCCATAG 1424. chr9_USP20_NM_006676_-2.12787
TGGGGGCCTGTCGTCACCCTGGAAGACTGCCTTGCTGCCTTCTTTGCCGC
TGATGAGTTAAAGG 1425. chr9_USP20_NM_006676_1.5256
GGTCCCTCCATGGCACTCTGGGTCCTCTCCTCACTCTCCAGAGACCCTCA
CATGTCCTTTTGAACATCCAAAG 1426. chr9_NCS1_NM_014286_1.76639
AGCCCGAAGTTGTGGAGGAGCTGACC 1427. chr9_LAMC3_NM_006059_1.68419
ACAATGGAGCCCAAATGGGGTCCTCCTGAGCC 1428. chr9_LAMC3_NM_006059_1.59808
AGAAGACCAAGCAGGCGGAGAGGATGCTGGGAAACGCGGCCCCTCTTTC 1429. chr9_AIF1L_NM_031426_1.84931
GTCGGGCGAGCTCAGCAACAGGTT 1430. chr9_NUP214_NM_005085_-1.73415
TTTCGATCCCTGGGACCAACCGCATCCTCAG 1431. chr9_FAM78A_NM_033387_1.8297
GCTGGTTTCGGGTCTAAATGCCCATCCTCACCCTTCTCCCAAGACAACCG
GGAAGAAGGGCTCAAGAGACTCTCGCGGGCGACCCCAACCCTCCCTCCAC
CTCTGGCAGAAGAGGAAAAGTCCGGTAGAAAAGAGATCCTGCTTTCTTTC
TCCGATTGGTTTTCTTCCTTTCAATTCAGCTTAAGGCAAAAGTTTGGCAA
AGCAAGTCTACATAAGGCCGCATGACAGAGGGCGGAGGGACCTGGGGGGA
AGGCCGGCCAGCGCCACAAATCGGCAGCAGTGTGGATCTGTCTCTTTGAT

Figure 3-117

CGGGGGCTGGAGCTTCCCTCCTAATCAGCTCCCCCTCCTCCTGCCCCTGA
GCCCCCAAAAGAGGAGTTTTTTTAAAAAACGGAAAAAGCAGTGTTTCAGG
GAATCTGTTACAAGTGAGCGACTGAAACTGAGAAAAAGGAGAGGCAAGGA
GACCAGAGGTCACCCTGAGGGCGCACGTGGGGTCTGTCTGTCCTGCTTAG
ATCTCCCCTCTCCCTGAAAGGAAGCAGGTGCCGAGAGCCGGGGAGGCCTT
CCCGGGGGCATCAGCACAGTGAGATCCGCCCGCTGGAGAGGGTAGAATGG
TTGTATCTTGCTGAATGACTGAAGAGTGAGTCTGAGTTTTGTTTTCAGCG
GTATTATTATTTGTGAGTCTAACCTAGCGGGT 1432. chr9_POMT1_NM_007171_-1.73004
CTGGCTAACACTGACAGGGGTCGCTTGTTCCTGTGCAGT 1433. chr9_UCK1_NM_031432_1.63027
GGCAGGCAGAACTCCTCGAAGGCCGGCTTCACGAAGGTGGTGTACTGCGT
CAGAATCT 1434. chr9_BARHL1_NM_020064_-1.62373
AAATGGAAGCGACAGACGGCCGTCGGGTTGGAGCTGCTGGCGGAGGCAGG
CAATTACTCAGCGCTCCAGCGGATGTTCCCGTCGCCTTATTTCTACCCGC
AGAGT 1435. chr9_TSC1_NM_000368_1.91741
TCCAAAGTGGGTCCAGTCGACAGA 1436. chr9_VAV2_NM_001134398_-1.54381
CCAAAGTCTCGCACATCGAAGAGGTCAAAGGGGTCAAACAGCTCGCTGTT
CCTTAATCCAAATTTATCGTGGCAGACTTTCAGGA 1437. chr9_COL5A1_NM_000093_-1.93374
AGGCAAGGATGGACTCCCAGGACACCC 1438. chr9_OLFM1_NM_014279_-1.85192
TGCCAGGTCGTTGGAGGTGGCAGCG 1439. chr9_OLFM1_BC000189_-1.86046
AGAAGACACTGAACGAGCTTCCCTTGTTTTGCCTGGAAGCCCACGCT 1440. chr9_KIAA0649_NM_014811_1.61233
TGCTTATCAGCACTCTGCAGCGCGACGGGGCTGCTCGGGGCACCAGCGAT
GAGCGCGCCGCACAGAGGGGCCACAGGGCAGAGGGATGCCACGACGCCAG
GCCGGCTGCCAAGCCCACCGTGCACAAGGAGCCACCCGCGTTGGCTGTCT
GTGG 1441. chr9_GLT6D1_NM_182974_1.80835
ATGATGTAGAAGATCACTCGGTAGCCTGTCATGAAGTGCTTATTTGCGGA
GTGTAGGAACGGCCTCAGGTACTCCTCTGCAA 1442. chr9_CAMSAP1_NM_015447_-1.68489
AGTCGCTGCACGACTCTTCCCGGTGCACCGACTTCGGCCGCGGCTTCTTC
GGCTTTGACTTGGGCTTGCCGAGCCCCTGCTCCTCTAGGATCTGCTGCTG
CTTCCTCCGCAGGTACTCCTGCTTGATGAGCTCGCGCCGCGCCTT 1443. chr9_SDCCAG3_NM_001039707_1.68196
AAGCATTTAGTGCTCATCGCCGTCCCTCTGAGGGGGGCCGTCAGAAAGGC
AACTGGGACCTGACAGACCCGGGCACATACTTGAAATTCCTGAA

Figure 3-118

1444. chr9_NOTCH1_NM_017617_-2.3553
AGGCACACTCGTGGGTGACGTCGCCCGTGGGGCGGCAGGTGCCCCCGTTC
TGGCAGGGCGAGGGGCTGCAGGGCACGTAGGGCCGCTCGCAGTTGGGGCC
AGTGTGGGTGGCGCGGCAGACGCAGCGGTAGGAGCCGACCTCGTTGTGGC
AGGTGCCTCCGTGGCGGCAAAGCCCGGGCTTCTGGCCACACTCGTTGACA
TCCTGCCGGCAGGT 1445. chr9_EGFL7_NM_016215_-1.91466
TCTGTGAATCCACCCCTGGCTACCCCCACCCTGGCTACCCCAACGGCATC
CCAAGGCCAGGTGGGCCCTCAGCTGAGGGAAGGTACGAGCTCCCTGC 1446. chr9_KIAA1984_BC007542_1.95638
CTGGGGAGAAGGCTTGACTATTTGA 1447. chr9_C9orf86_NM_024718_-1.76111
ACCCTGGGGGTGGCGACTACGAGGAG 1448. chr9_TRAF2_NM_021138_1.79469
GTATCTACCTGAACGGCGACGGCACCGGGCGAGGAACACACCTGTCCCTC
TTCTTTGTGGTGATGAAGGGCCCGAATGACGCCCTGCTGCGGTGGCCCTT
CAACCAGAAG 1449. chr9_FBXW5_NM_018998_1.79269
CTTGGAGCAGGACGCGAACTGGTACCCGGAATGGGAGAAGCTGAGGTGCA
GGACCTGGTCTGTGTGTTCCCGCAGCGTCTGCACCTCCACGCAGGGCACC
GTGTCATACAGCCGCTGGAACTCCTCGTACCAGGA 1450. chr9_LCNL1_NM_207510_1.57868
GGCACCTGGTACATGGTCGGGGTGGTGTCAGATG 1451. chr9_LCNL1_NM_207510_1.72642
CGAGCGCCCGAGCTGTTTCCCGAAGGCGCCCAGAAGATGCAGCTACTGGC
GCCCCAAGT 1452. chr9_ABCA2_NM_001606_-1.55001
GTACCCAATGAGGGCGATGGCCGTGGAGAGCTTCCGCTTGTTGCCGCCGC
TGTAGGTGCCAGCCGGCTTGTCTGCGTACTTGGTCAGCTCCAG 1453. chr9_C9orf139_BC132809_1.62232
GCTTGCTCCTTGAGGACCCTGGGCAGGGTGGCTGCCATGGGGCCCAATCG
TGCGTGGGAACCTGCGAGCTGGCAAACGGGGCTCGGGGGTTTTGCCCAGA
AATGGGTCAGAACGAAAGCCTCTCAGA 1454. chr9_C9orf140_NM_178448_1.61595
TCCGCGCTGGAGCTCGGTTCCAGCGCCGCG 1455. chr9_UAP1L1_NM_207309_-1.51149
ACGTCATGACCAGCGAGTTCACTCTGGGGCCCACGGCCGAGTTCTTCAGG
GAGCACAACTTCTTCCACCTGGACCCCGCCAACGTGGTCATGTTTGAGCA
GCGCCTGCTGCCTGCTGTGACCTTTGATGGCAAG 1456. chr9_NOXA1_NM_006647_1.60021
CCAGGTGGAGCAAGTTGGCAAACAGGCTCCT

Figure 3-119

1457. chr9_ENTPD8_NM_001033113_-1.58945
GAGCACGCTGGTGGCCTCCACCAGGAGGAGAATGAGTGCCGTGAGGCCTG
AGACCC 1458. chr9_CACNA1B_NM_000718_-1.72596
GAACTCGGCCAAGGCGCGCTCGGTGTGGGAGCAGCGGGCCAGCCAGCTAC
GGCTGCAGAACCTGCGGGCCAGCTGCGAGGCGCTGTACAGCGAGATGGAC
CCCGAGGAGCGGCTGCGCTTCGCCACTACGCGCCACCTGCGGCCCGACAT 1459. chrX_GPR143_NM_000273_-1.64915
GCCGAGAAGGTCGCAGGCAGCGGCAGCGCGCAGGATGCGGACCGAGGCCG
GCGGGGACGTCGCGGGGGACCCGGGGCCCGCGGGCCGGCGGCCGGGCAGC
AGCTGCAGAAGGCCCAGCGCCAAGCGGAGCCCGCCGCTGCCCAGGCAGAG
CGCGTGGAAGGCCCGCGGCTGGAAGCTCAGCACGAGCTGCGTGGCTGCGT
CCCGCGTGGGGCAGCAGAAGGTCCCTAGGCGCG 1460. chrX_SHROOM2_NM_001649_-1.99571
TCGCCCCCCAGAAACTGACGGACAA 1461. chrX_CLCN4_NM_001830_1.63447
TGGGTCCGCTCACGACCGTCCTGTTTCTTGCTCC 1462. chrX_AMELX_NM_001142_2.29346
CAGCAGCCCGTGATCCCCCAGCAACCAATGATGCCCGTTCCTGGCCAACA
CTCCATGACTCCAATC 1463. chrX_ARHGAP6_NM_013427_-1.64718
CGCCGCCGGTGCGCTCCAAGTGCCCCGGCG 1464. chrX_PRPS2_NM_001039091_-1.62552
GCCTCCCGCGTCGCTGTCGCTGTTGCCTCCGCC 1465. chrX_PRPS2_NM_001039091_1.5182
TCTTGGCCGAAGCAATCCGAAGGACACACAATGGGGAATCCGTGTCCTAC
CTG 1466. chrX_GRPR_NM_005314_1.61388
TCCCGGAAGCGACTTGCCAAGACAGTGCTGGTGTTTGTGGGCCTGTTCGC
CTTCTGCTGGCTCCCCAATCATGTCATCTACCTGTACCGCTCCTACCACT
ACTCTGAGGTGGACACCTCCATGCTCCACTTTGTCACCAGCATCTGTGCC
CGCCTCCTGGCCTTCACCAACTCCTGCGTGAACCCCTTTGCCCTCTACCT
GCTGAGCAAGAGTTTCAGGAAACAGTTCAACACTCAGCTGCTCTGTTGCC
AGCCTGGCCTGATCATCCGGTCTCACAGCACTGGAAGGAGTACAACCTGC
ATGACCTCCCTCAAGAGTACCAACCCCTCCGTGGCCACCTTTAGCCTCAT
CAATGG 1467. chrX_CTPS2_AF226667_1.56591
TGAAAACAGTTCTTCTTATTCCCAGTCTCATTGTTCCTCCCAAATTGCCA
GGGTTGTGCTCGGGCATATCAA 1468. chrX_CTPS2_AF226667_1.65171
TCCCCAGGTAATCACCACGCCTCTCTTTATTGATCA 1469. chrX_SYAP1_NR_033181_-1.59634
CTCCGGCTGGCGTGCAATTTAATTTCGACTTTGATCAGATGTACCCCGTG

Figure 3-120

GCCCTGGTCATGCTCCAGGAGGATGAGCTGCTAAGCAAGATGAGATTTGC
CCTCGTTCCTAAAC 1470. chrX_PPEF1_NM_006240_1.52107
TGGAAGAATTCTATGCCTGGCTCCCAATCGGTACAATCGTTGACAATGAA
ATCCTGGTCATCCATGGTGGGATATCAGAGACCACAGACTTGAATTTACT
CCACCGTG 1471. chrX_PHKA2_NM_000292_-1.69895
GTGAGGACGGCAATGCTGATGTCCTGCCCACTGGCCTCGTAGATGAGTTT
TGTGAGCTCCTCTGG 1472. chrX_KLHL34_NM_153270_1.64657
GGCGGTGGCTGCACACCATCACCTGGAAGAACCGAGTTGCCGGTGGACTC
CGGGGGTGCTGGATGTCCGACGGCGCAGATGCGGCGTCCCGGGAGTGCAG
GGCGAGGACTC 1473. chrX_PHEX_NM_000444_1.60166
TCAATCAGTAGAAGGCGGGACACCGAAGCCATACAGAAAGCCAAAATCCT
T 1474. chrX_IL1RAPL1_NM_014271_-1.60319
TCTGACTGATAAGCCACCCAAGCTTTTGTATCCTATGGAAAGTAAACTGA
CAATTCAGGAGACCCAG 1475. chrX_TAB3_NM_152787_1.76514
CAGGTGTACCGTGGCATCTCGCACTGC 1476. chrX_BCOR_NM_017745_1.63262
CAGAAGGGTCTCGCCAGCGTTCTTATTGACAATAAGTCTCCGTGCTTCCG
GCGGCATAGGGCGAGACTGGGTGGTCTCCTGAGGGGAACTTGAGCATGGC
AGCTGTGTGGACTGGGAGGCTGGTAGCAGTTGCTGCAAGCGGTCGAAGGG
CTTTGGCTCCTGCTTGGCTGGTGACAGATCATAGTCCGAACTGGGCTCCG
G 1477. chrX_MED14_NM_004229_-1.77095
GGGCTTGGCGCAACGGCACACGATGCGGTCCTCGAGCCTCCCGGGCGCTC
GGTCACCGCGCCGAAACGGGAGCGGGCAGAGTCGCCACCGCCTA 1478. chrX_USP9X_NM_001039590_-1.7447
ATGAACATGAGTCGCCTCCACCTGAAGATGC 1479. chrX_USP11_NM_004651_-1.68722
AAGAAAGATGGCACTTGGCCCAGCGCACA 1480. chrX_ZNF41_NM_007130_-1.67292
GCCTCTGACTTGGGAATTTGGTAC 1481. chrX_ZNF41_NM_007130_-1.59949
ACCATGGGGGAGAGTCCCCATTAGCTGCCAT 1482. chrX_ARAF_NM_001654_1.51627
ATGGCTTCCGTTGCCAAACCTGTGGCTACAAGTTCCACCAGCATTGTTCC
TCCAAGGTCCCCACAGTCTGTGTTGACATGAGTACCAACCGCCAACA

Figure 3-121

1483. chrX_PORCN_NM_022825_-1.71849
GCACATCTGTGGACCCTCATAACCCTCTTAAGACCCCTCTCAGGGTGCCA
CTGATGGGGGATGAGGGAAGGCCCTCTCTCTACTCCTTGA 1484. chrX_WAS_NM_000377_-1.99128
GCCGCCCAGCTCCGGGAATGGACCA 1485. chrX_WAS_NM_000377_1.64743
TGAGTTACTTGCTGCCCTGTGCTCCTCCCCGCAGGACATGGCTCCCCCTC
CACCTGCTCTGTGCCCACCCTCCACTCTCCTCTTCCAGGCCCCCAACCCC
CCATTTCTTCCCCACCAACCCCTCCAATGCTGTTATCCCTGCCTGGTCC 1486. chrX_PQBP1_NM_001032382_1.8001
ATCGTAGCGGCGACACGAGAGAGACGGGCGGTGTGACAGCCTT 1487. chrX_SLC35A2_NM_001032289_-1.68555
CGGAGGGTGGCGACTTGGGTCCTGCAGATGCCCAACACCCTCCACCCCAG
TCCCCCTCCCTTGTGTCCCCCCATTGCTG 1488. chrX_GPKOW_066359_-1.62855
TCCTTTTCCCAGGCCGGCGCGCTGCTTGCTGGGAA 1489. chrX_MAGIX_NM_024859_-1.56628
CGGGGACGTCGTGCTCCACATCAACGGAGAGTCAACGCAGGGCCTCACCC
AT 1490. chrX_PRICKLE3_NM_006150_-1.58043
CAGTGATGGTCACCGGGAAGATGCGCACGATGCCACGCCCCAGATTCTCC
CGCTTCCGCTGCTGGCTAAAGGCTCGGAGCTCTTTCTTT 1491. chrX_CACNA1F_NM_005183_-1.5471
CCTCCTCATCGAAGCGGGAGAGGATGGACTCCTCGTCGCTATAGAGAGAG
CTGGTTCCCTGTGCCAGCAGGTCACTGGCAGCATTGTCCATCTCATCCAG
CGTCAGGCGACACGCATCTGCAATCTCCTGCTTGGCCAGGGCCACGAAAC
GTGGGTCTCGAGCAAAGAGGCC 1492. chrX_CCDC22_NM_014008_1.50984
ATGTGTCCCGGCTGGCCTACACCCAGCGCATCCTGGAGATCGTGGGCAAC
ATCCGGAAGCAGAAGGA 1493. chrX_CCDC22_NM_014008_1.60718
GAAGATCCGGGAGGACTACCGAGCCCTCCGCCAGGAGAACGCTGGCCTCC
TAGGCC 1494. chrX_FOXP3_NM_014009_-1.57884
AGCGGATGAGCGTGGCGTAGGTGAAAGGGGGTCGCATGTTGTGGAACTTG
AAGTAGTCCATGTTGTGGAGGAAC 1495. chrX_AKAP4_NM_003886_-1.70611
CTTTATCTTCTACATTCAGGGTGGACACATCGACAAAGCATAT 1496. chrX_KDM5C_NM_004187_-1.51918
GATAAACTGGAGGGCATCAACTGGGGGAGGTTGTAGTGTAGGAGTTTGGG
TGAGGGGGCCCGAGCCCATCTGTTTGGACTTGAGGGAAAGTGGCTTGGGG
TTAGAGTCGGGGGAGGATCAGAATGTCTTGCCCAAGGTTAAGAAGCTGGT

Figure 3-122

GGAACTTGATTTCAGAACCCAGAGCTCCCTGGCTTCAGCCCTAGTGCTCC
TGCCAGCACTACAGCTGCTCCACTGACTGGTGATGGAAGCACTGTCTTCC
CCGTCTAAGA 1497. chrX_FGD1_NM_004463_1.73267
GTGGTGCTGTGGACTGGGACCGCAGGGCAAGACCCGGTGGCCTGGAGCAG
CGCCCAGGCTGGTGTCCGAGGGTCCGACAAACTGGGGATCCAGTGGGCCG
CCAAGAGCCGAACCTGAG 1498. chrX_FGD1_NM_004463_-1.85574
TTCCGAGGCTCCAGGGTCCGAGTCGGCACAGGCCGGCGGAGCGGCGCCCG
GCGGGTTCGTGGCCGGGTGTTCGGGCTCCGA 1499. chrX_LAS1L_NM_031206_-1.71343
AGGCGACCACGATGCCGTGGGCCGAGAGTGGCAACGACCCTTTCC 1500. chrX_VSIG4_NM_007268_1.5031
GGCCAGAAACTCATAATCCAGAGGAACTGTGTCCAGCAGGCGGGCGTAGT
TGCCATTGATCTGGGCGATGATCTGGTACTCCTGTCCTATGCAGGGCTCA
TCAGAGTAGTTGTTGCCCAGATTCTGGGAAGTTGGCTCATCACTGGAGCA
GCCACTTGCGAAGATGGCCACCCTCATGGTTTCTCCAGAGTCGTTGGCC 1501. chrX_VSIG4_NM_007268_1.74093
ACTTCACACGTGTAGTGGCTCCGGTCATCCATCTCCAGGGTGCTCAATTG
GAGGGATACATCTCCTGGAACCTTGTGGCTCACATGCAGGCGGCCCTGGT
ACTTTGCCTGCTGGATATGGTCTCCAGAAGAGTCACGTAGAAAGATGGTG
ACAGGGTCTGAGCCACGTTGTACCAGCCACTTCACCAAGACTTGGGTGTA
GCCTTGCAGGGGGTCATAGGTGCAGGGAAGATTCACATCCCCTTTCCAAG
GTCCTGTTACACTCTCTGGCACTTCCAGGATGGGACGGC 1502. chrX_AR_NM_000044_-1.64178
GGTAACTCCCTTTGGCTGCGAGCGGGCGAGCTAGCTGCACATTGCAAAGA
AGGCTCTTAGGAGCCAGGCGACTGGGGAGCGGCTTCAGCACTGCAGCCAC
GACCCGCCTGGTTAGGCTGCACGCGGAGAGAACCCTCTGTTTTCCCCCAC
TCTCTCTCCACCTCCTCCTGCCTTCCCCACCCCGAGTGCGGAGCCAGAGA
TCAAAAGATGAAAAGGCAGTCAGGTCTTCAGTAGCCAAAAAACAAAACAA
ACAAAAACAAAAAAGCCGAAATAAAAGAAAAAGATAATAACTCAGTTCTT
ATTTGCACCTACTTCAGTGGACACTGAATTTGGAAGGTGGAGGATTTTGT
TTTTTTCTTTTAAGATCTGGGCATCTTTTGAATCTACCCTTCAAGTATTA
AGAGACAGACTGTGAGCCTAGCAGGGCAGATCTTGTCCACCGTGTGTCTT
CTTCTGCACGAGACTTTGAGGC 1503. chrX_AR_NM_000044_1.50372
CCTGGATGGATAGCTACTCCGGACCTTACGGGGACATGCG 1504. chrX_NLGN3_NM_181303_-1.58918
GCAGACATTGCACCCCTATAACACCTTTGCCGCAGGGTTCAACAGTACCG
GGCTGCCCCA 1505. chrX_TAF1_NM_004606_-1.6285
CAGCAGCTACCATCACTGCTGCCGCCAT 1506. chrX_HDAC8_NM_018486_1.53135
AGCCCATATTCTATGGAGTCCGGATGATCATCATCGCCCTCTTGGCTGAC
CTTCTGGAGATGCTGCAGATAAGCATCAGTGTGGAAGGTGGCCATCTCCT

Figure 3-123

CCATGGAGGCCACTTTAGGCTTAAC 1507. chrX_CDX4_NM_005193_-1.563
TGTACCCGGGCACTCTCATGAGCCCTGGGGGCGACGGCACAGCTGGGACA
GGCGGCACAGGGGGCGGTGGGAGTCCGATGCCAGCCTCCAATTTCGCTGC
GGCACCGGCTTTCTCGCACTATATGGGGTATCCTCATATGCCCAGC 1508. chrX_MAGT1_NM_032121_-1.54316
TTGGAGAGCAGTGAACATGACGATAACGGAGTAATTTCTCGGTGGGGCTT
TCACAAGGCGACGGAACTTGTCTCCATTCATTCTTATTACAGGTC 1509. chrX_SH3BGRL_NM_003022_1.53262
GCCAACCGCTGTTTCAGCCCCTAGCTGGATTCCAGCCATTGCTGCAGCTG
CTCCACAGCCCTTTTCAGGACCCAAACAACCGCAGCCGCTG 1510. chrX_SRPX2_NM_014467_-1.87704
TCCCATATTTCTGCTTCCCCTCACTTTTAGAAGTTAATTGATGGCTGACT
TCTGAAAGTCACTTTCCTTTGCCCTGGTACTTCAGGCCATATACATCTTT
TCTTGTCTCCATAATCCTCCCTTT 1511. chrX_ARMCX1_NM_016608_-1.68893
CGTGGCCGCTGGTGTGGTTATCGGGGCTGGTGCCTGCTACTGTGTATACA
GACTGGCTTGGGGAAGAGACGAGAACGAGAAAATC 1512. chrX_ARMCX2_NM_014782_1.5925
TTGGGTACCGCTCCAGTCGCTGATGTGGCTTTCGGTATAGCCCCAGTGTG
AGCCCCAGGGGTTGCTTTCTTGGCAGCTGATGTTCCAGGAACCACCGCTG
TT 1513. chrX_NXF4_NR_002216_1.51506
GTAGGTAGGTGGGTAGGAGGATCATGAAGGCTCTAGTTTTTTCTT 1514. chrX_ESX1_NM_153448_3.34522
AATTCAGGCGTGCTGCAAGTCTCT 1515. chrX_MORC4_NM_024657_1.55007
TGGGCAATGAATCCTCGGTAATAATCAT 1516. chrX_TEX13B_NM_031273_1.87287
TGCTGATGGAGTTCGGAGTCTCTCCTGTCTCTTGGGGGCTCTTGAGGGTC
TATTCCCTGGGCCTCC 1517. chrX_VSIG1_NM_001170553_1.54836
TTCTAAGCCCCTTTGTAGCGTTCAAGGAAGACCAGAAACTGGCCACACTA
TTTCCCTTTCCTGTCTCTCTGCGCTTGGAACACCT 1518. chrX_COL4A6_NM_001847_2.35608
TGCGGGATGGTGATGTCCTGGCTGT 1519. chrX_COL4A6_NM_001847_-1.51173
GGCCAGCTGCTCCAATTGTGGTACGGCCTGGGTTTCCTTGGTCCCCCTTC
AGCCCTGGAAATCCCTGAGGCCCTAGGGCT 1520. chrX_KCNE1L_NM_012282_-1.65193
TGGAAGGTGGGAGGCGCGCCCAGGGATGAGCGAGATGAGGAGGGCGCGAA

Figure 3-124

CCAGCAATCT 1521. chrX_ZCCHC16_NM_001004308_1.63565
GGCAACATTGAGTGGCGGACAACACTTTTTGGCATCTCTCCAATTCAGCT
GTTAGCATCTCCTAGTGTCTTCTTCACAGCTAACAGCTTTGGCTACTTGC
TCATGACACTCCGTCTCTGA 1522. chrX_AMOT_NM_133265_-1.71241
TCTTATTTGTCCTTCTTAGCAGCT 1523. chrX_LRCH2_NM_020871_1.50683
TTATCACTTCCAATTCCAGAGTCAGGGCCATGATTTTTATT 1524. chrX_IL13RA1_NM_001560_-1.77535
TTATATTCCCTCCAATTCCTGATCCTGGCAAGATTTTTAAAGAAATGTTT
GGAGACCAGAATGA 1525. chrX_PGRMC1_NM_006667_1.73176
CATGAGATTTTCACGTCGCCGCTCAACCTGCTGCTGCTTGGCCTCTGCAT
CTTCCTGCTCTACAAGATCGTGCGCGGGGACCAGCCGGCGGCCAGCGGCG
ACAGCGACGACGACGAGCCGCCCCCTCTGCCCCGCCTCAAGCGGCGCGAC
TTCACCCCCGCCGAGCTGCGGCGCTTCGACGGCGTCCAGGACCCGCGCAT
ACTCATGGCCATCAACGGCAAGGTGTTCGATGTGACCAAAGGCCGCAAAT
TC 1526. chrX_SLC25A43_NM_145305_-1.62131
TGGCTACGTGGAGGCGGGACGGCCGACTGACAGGCGGCCAAAGGCTGC 1527. chrX_RNF113A_NM_006978_2.257
TGATCCACCGCCTTTCCTGGAGAA 1528. chrX_GRIA3_NM_007325_1.80422
GTAGACCTAGCCTATGAAATAGCCAAACATGTAAGGATCAAATACAAATT
GTCCATCGTTGGTGACGGGAAATATGGTGCAAGGGATCCAGAGACTAAAA
TATGGAACGGCATGGTTGGGGAACTTGTCT 1529. chrX_XPNPEP2_NM_003399_-2.50596
TTAGTGGTCTCCACCCTTGCCATCC 1530. chrX_AIFM1_NM_004208_-1.90343
TCTGCCTCGGGCTTCGGACGCACACGGTCCGCACCAAGGGCACCAGCTTC
TGCTTCAAAGCACCCGCCGC 1531. chrX_SLC25A14_NM_003951_1.91727
TCTGGCATCGGTGGTTTTACTTCTTCGATTGAACCCTGCTTCCTCGACCC
CCCTGGGAGGCCGCCTTCTTCAGGCGCCTCCCTTCTCTCCACGAGCTCGC
TCTGA 1532. chrX_MST4_NM_016542_1.73503
TACCACCGTACGAAAGAAGCCTGATC 1533. chrX_MBNL3_NM_018388_-1.54346
TGCAGGGATAAATGCCGGCTGTGGGAGCTGCA 1534. chrX_HS6ST2_NM_001077188_1.74538

Figure 3-125

CAGCGTCGCCTGAGGACGTGCATCCGCCTGCGGCGGCCCCGGGACAGCAG
CGCGAAAAGCGGGGCGCACGC 1535. chrX_NCRNA00086_NR_024359_-1.73023
GGCCTGATGACATGCCCCCTTGTCC 1536. chrX_MCF2_NM_005369_-1.94235
TCTTGCCTCTCCGGGGATTTGCTTC 1537. chrX_AFF2_NM_002025_1.53583
GTCACCTGGAGATGACGTCCTGGGCGGCTCTGCCCCTTCTATCCAGCAGC
AGCACTAATGTCCGGAGACCCAAG 1538. chrX_CXorf40A_NM_178124_-1.93942
GGCCCATGCTGCGGGAGCCTGTGTG 1539. chrX_HMGB3_NM_005342_1.85097
TGGAGGCAGCTAGCGCGAGGCTGGGGAGCGCTGAGCCGCGCGTCGTGCC 1540. chrX_MAGEA10_NM_001011543_1.59332
TCTTCAGGCATGCAGCGCTGACGCTTTGGAGCTCGAGGCAT 1541. chrX_DUSP9_NM_001395_1.92895
TGTCTTGACGGGATCACTGGGGCTC 1542. chrX_PLXNB3_NM_005393_-1.50615
CGTACCCCTGTGGCGACGAGCACACCCCCAGCCCCATTGCTGGCCGCCAG
CCCCTGGAGGTCCAGCCTCTGCTGAAGCTCGGGCAGCCGGTCAGCGCCGT
GGCAGCTCTCCAGGCAGATGGGCACATGATAGCCTTC 1543. chrX_PLXNB3_NM_005393_1.76505
CAGCTCACCATCCGAGGTCAGCACCTCCAGACAGGTGGCAACACCAGTGC
CTTCGTGG 1544. chrX_PLXNB3_NM_005393_-1.51889
AGGGCCTCAACCTGGGCATCAGCAAGGAGGAGGTGCGCGTGCACATCGGC
CGCGGCGAGTGCCTGGTGAAGACGCTCACGCGCACCCACCTGTACTGCGA
GCCGCCTGCGCAC 1545. chrX_PLXNB3_NM_005393_1.84469
GACAGCAGCAAGCCGGATCCACCAACACCGCAGCGCCTTATGACCCCGGA
ACCGAGCCAGCCACTGAGGGGAGCTGGCAGAGCCTGGGGGCACAGGGTGC
AAAGCCAGGCACTGTGCCCAGCAGTGGGCTCCCTGCCTGCCACCTCCCCT
GCCAGCCCACCCACCTTCCCCCCACCTGAGATTGTTTCTAATTTATAAGG
ATCCCCCTCCTTCCCCCTCTCCCCATTGTATTTATTTGCCTGCTGGAAAA
TCACA 1546. chrX_SRPK3_NM_014370_-1.59009
GCCAGCACGGGCGGTGGTGGGGACAGCG 1547. chrX_HCFC1_NM_005334_-1.68402
CACCAGGAGGCGAGTCCCGTCACACACGAAGCCATAGGCTGCACACCCAG
GGGGAATGTCCCCCCTCACGGCTGGGATGAACCACTGGT 1548. chrX_MECP2_NM_004992_-1.51053

Figure 3-126

ATGGGTACTGGAAAGCTGTCGGTCAATTCTGCTGTTCACAAATTCACTGA
AAGAGGCCCCCATCTTCATAATGTTCAAGTACAGACAAAATTGAAATTGA
GGTCACACCCCAAAACTGGGCCGGACACAGCTGGTGAGAATCCTGCAGCT
TAAGGCTTTCCCTCCAACCTCCTGTCAACCTGACCCCAAGGCAGGGGCAG
CATGAGAGCTGCAGGGCCCCTGCCTGCCAGGGCGATAAACCGCCAAGGCT
GCCTGCTGAAAGGCGACTGACTCGTGATGCCTTTGGGAAACACGAGGGAA
TGAGGAAGAAAGGGGGAAATAGAGAGAAAACCCTAAGGAGCCTCAGGCCC
CACTGGCAGCTCTGGAATAAACTGGAAGGGAAAGAGGCTGGGCAACTGCC
TCTTTGAGGGAGCTGCAGGTGGGGCCCGAATGAAATAAAGTGACGCTTGA
AATGCTGTGTTCCCAACCACGACTGCCCCATCGGCCCTGAATGAACTGTC
ATGGGTGACAGGGGGGCCTGGTGGGCCACGCACTCCTCTTACCAGGACCA
GATGACGCCCAGGTGACGGGGAAGCAGCTCTGGACAATGATTCCAGAAGC
CACATTACATTTGACTAAGTATAATACATAAAAACCCAACTGACCAAAAT
AAACATCTTCTCAGTGACAACCTGGTCGGATGCTGCGCTCTCGTGGATAA
GTGTCCTTTGGTAGTGCCAGGAGTTCGAGGCCACTATGGGGGCAGGAGCC
TTCTGTCCTTGGAGGAAGAGTTCTGGAGGACTCACCCTCTCTTCTGACCC
CCCTTCCCTTCCTGGGGAAGAGTCAGAAGTGAAGCTGGGGGGGTCATCAG
CAGAGCAGGTGGAAGGGATCAGGGATCAGGGATTGGGCTGATGGGAGTTT
GGTTGCAGGACTTGCTTTTACAGCATAAGGAAATGGACACATATATGCTA
GAAAGTCCAACTATGAGACTCTACAAACAGAACGGGGCAAACTCCCTCAC
TTCTAACCATTCCAGAAGAGACAAACACGGTTTTTTCTTAAGCTACTGAT
TGGAACTGTCAACTATGGTTCCTGATCACTAAAGACTGGCAAGGAAGTGC
TAGACAGTTTCTATGATGTTTCACTCCTTCATGATTACACCATAGTAAGG
AAGCCAGGGACAATAACTGAAATACACAAGACAACACACACTTGACAGTT
CATGGCAGCAGCTCACATGGGACATGCCTGTGGGTGTTTCTGGAAGCATA
AGACTGCTGTCTCATTTGCTACTTTGATAAGGTACTTCTCAGTTGGACAG
ATTTAGATATAAGAGACATCTCTGTAAACACAGAAAAGGATATACCAATA
TGATGAAGATATGCAGCTAGATAAGGACTTCCTGAACAGAGGTTAAAAAG
ATGGGATCCCACATGAAAACTGATCAATTAAAAACCCACAGCAAGCCCAT
GCCTCTAAGCCCCTACACCACAGCTATGGACCAGACAGACAGTGAAATGT
GTGGTGTTCTGGCCCCCTGTCTGCATCGAGCAAAAGCAAAACATTGCCAT
TCAAGAAGAACTCCGAGGGAAAAGGGGGAGCAGAGGAAGGGCTGGGGACC
CAGGTACTGGTCCCAGCTCGGGTCTTGGGAGTTCTGCATTGGTACCGCTA
CTGCCCTGCTGCACTACGCTAGACTCTGGACTTCTGAGTGAGGTCAAGGT
CGGCTGGCATGGAGCCCCTGTTGGGCCACTCGATGACTGGCAGGCCACAG
GAGGCCTCTGTGCTTTCCTCAACTACCAAATCGGGCCCAGCTCCTCCAGT
CCACTTCTCTAGAGTAGAAGGGTGAAAAGGCTCGTTGTTCAGGGTGGGAA
ATGCCTTTTGCTTTTTCTTACCAGGGAAGAGGGGGCTACCTAGGAGAGCA
AGACCTTGCTGCTCTCTTGCTCTTCACAGACAGGCCAGGTCGGACTCAGC
AGAGCCCAAGGCCTCCTCAGGGCTCAAAACAGGGTGGGCTGGTACTGGC
AGCAGGAGGACAAAGGGCAGGCAGAGTTCTGGGGACTGGAGCCGACAAGT
GTGGTTGGGCACCGCGGCTGCCTGGAAGAGAAGGGATGAACTAGGAAGGA
GGAGGATGGAGGAAGGGAAAGAAGTGAAAGGATGAAATGAACAAAAGGCA
GAAATGGAAGGGGAGAAGAGAAACCAATCAGGAAGTCCTTATAAAATTGC
AGCAAACACTTAGAGTTTCGGAGCTTCGTGGGAACCCTATGTGCTGAGCC
CACTTTAAAACAAGCGCAGGTATATATACAAATCCAGGTAGTTCTCAACA
CTGTCACATCTGGTGGCTTGAGGGACTAA 1549. chrX_FLNA_NM_001456_-1.5789
GGCCGCCGTACTTGATGGAGATGAGGTAGCTGCCAGGTGCCATGGGGGTA
TAGGTGACGCGGTAGCCCTCAGGGCACTCCTGGCAATCCATCTTCACCTT
GGAGGGGCCGTCAATGGTCACCGACAGGGCACCAGCTCCCGCATTGCTCG
TGTTCACG 1550. chrX_FLNA_NM_001456_-1.53179

Figure 3-127

CGGGCACGCCGTCATAGGTCACCTCCACCTCATAGGGCCCTTCCTCACGG
GGCAGGAAGCGCACCACACTGTTGTCAGCCCCCAGGCCTGGCTCCACCTT
GCAGGGCACCGCTGCACCCGAGGGGCCCACAATCTTGGATGCCACTTTGC
CTTGACCACCAGCACCCTTTGATTTGA 1551. chrX_ATP6AP1_NM_001183_-1.69995
CGCTGGTGCTGTGGTCGAGTGACCG 1552. chrX_PLXNA3_NM_017514_-1.66922
AGCGCCCAGGTCCCAGTGAAGGTTCTCAACTGTGACAGCATCACCCAGGC
CAAAGATAAGCTGCTGGACACTGTGTACAAGGGCATTCCGTACTCCCAGC
GTCCCAAAG 1553. chrX_CTAG2_AJ223040_1.62655
AGGTCAGGGCCCACGAGGATGCGGAGGCAGA 1554. chrX_GAB3_NM_001081573_1.68816
TGGTTTCCTCAGTGGCTACGGCATTAGTGTTTGGGTCATCTCTTGGCAAA
GAGGAGCTGGCAGCATGGGCGGTAAGAAGGGAGCTGGCAGAGGATGGCTG
CAGGGAGGAGGGCGTGTAAGAGAGGCTCT 1555. chrX_CLIC2_NM_001289_-1.52797
CTTTGTCTTCAGGACACGTGTGGGTAAATTCTTCACGGGCATAGGCATTG
TGGAGATAACGCCAGACTC 1556. chrY_PRKY_NR_028062_-1.81549
ACGCGGCCACCGAGCTGGAGGAGGCGGCGGGCGTGAGACCGGGAATGCTT
GGGGCCCCCGCCTTCCTCGCAGCCATCCAGCACTCGGTGCACGCCCCGCG
AGGCCAGCGGCTGCTCCCTCCCGGGGCTATTGCTGCTAG 1557. chrY_---_---_1.95935
GTAGTGCAATCTCCAGTGGTCTTCA 1558. chr10_ZMYND11_NM_006624_-1.52942
TGCGGCGGCGCCTGACAATGCCCCCTCGCGCCCCGGCCTCGGCGCCCGCT
CCCGGCTCCAGCGCGCCTG 1559. chr10_DIP2C_NM_014974_-2.35308
ATGCCATGCCAGAGCCCGACGTCCTTCTTGAAATC 1560. chr10_WDR37_NM_014023_-1.52948
CTGACAAGGACGAGCCCGACCTCGATGGGGATGTGTCCAGCGACTGCCCC
ACCATCCGCGTCCCACTGACATCCCTCAAGAGCCACCAGGGCGTGGTCAT
CGCCTCCGACTGGCTGGTTGGGGGGAAGCAGGCTGTGACTGCCTCCTGGG
ACCGGACGGCAAACCTGTACGACGTGGAGACGTCCGAGCTCGTTCACTCT
CTG 1561. chr10_PFKP_NM_002627_-1.71126
ATGGTGGACGGAGGCTCAAACATCGCAGAGGCCGACTGGGAGAGTGTCTC
CAGCA 1562. chr10_PFKP_NM_002627_-1.71467
GGTGAGTGCCTTGGCCTGCGGTGCGGACTGGGTGTTCCTTCCAGAATCTC
CACCAGAGGAAGGCTGGGAGGAGCAGATGTGTGTCAAACTCTCGGAG

Figure 3-128

1563. chr10_----_----_-1.88101
CAGGAGAATCACTGGAACCCAGGGGGTGGAGG 1564. chr10_----_----_-1.5545
CACGAGAATCGTTTGAGCCTAGGAGGTGGAGGTTGCACTGAGCTAAGATC
GTGCCACTGCACTGCAGCCTG 1565. chr10_IL15RA_NM_002189_1.60813
TGGGAGCCCGGGACAATAGCTGCTGTTGTGGCCGCTGTGTTGTTTGA 1566. chr10_FLJ45983_NR_024255_-1.7135
AGGGACGGCTTCTTCTATCTCGAATTTTTGCATTTGTAGGGAATTTTATG
GGGTAGAGGAGCGAAGAGGGAACAATGTCTCCAATTCAAATAAAACCCCA
AATTAAGCTCTCAGCCCCATCGGTGGGATAGCCTGCGGGGGAACCCACTC
CCTCTCCTGGCAGCATTGCCCTGGGGGCGAGCAGAGAGTGGATTTGGAGT
CTTCTTTTCCCGCCTGACCCCTGCTCGCCCGAGCAGCATTTTCGGG 1567. chr10_C10orf47_NM_153256_-1.69473
GCATCACCGTGCAGTTCGCGGGCCGCGGCT 1568. chr10_BEND7_NM_152751_2.16421
TGGGAGCATATAAGGGAAATTGGA 1569. chr10_BEND7_NM_152751_-1.9592
AGAGGAGTTCAAACGTGGAGGCCAGACTAAATCCAGGTCCTGGGGCTCTT
CTTTTAGTTTCTCTCCTTCTTTGCCAACTCGCTGATAGATCCGCCCAGTG
CTGTCGTT 1570. chr10_HSPA14_NM_016299_-1.74906
TGGCGGCCATCGGAGTTCACCTGGGCTGCACCTCAGCCTGTGTGGCCGTC
TATAAG 1571. chr10_HSPA14_NM_016299_1.66511
TGGACGAATCAGGAGCCAGTAGATT 1572. chr10_RSU1_ENST00000377921_-1.64904
ACAACAACAAAGCACGTGGGCGATGACAGCAAGCGCAGAGGCGGAAAGGC
AA 1573. chr10_CUBN_NM_001081_1.53346
CGACACTGATGCGGTGACCGTGGTGTGGAAACCCCCAGCACTGATGCTAG
AATCAGAGACGAATCTCAGCGTCAGGGCGCTGCTGAAGGATGTGATAGGA
TGGGGCATGTCGGTGCCACAGTAACGGC 1574. chr10_STAM_NM_003473_-1.57919
TCCCCGGGGACACCTCGGCACGCAGCGGAG 1575. chr10_CACNB2_NM_201590_-1.71741
TGCTTGACAGACGCCTTATAGCTCCTCAAACTAAATACATTA 1576. chr10_PLXDC2_NM_032812_-1.57172
CCAGTTTAACAGATGTGGCCCCTGTGTATCTTCTCAGATTGGCTTCAACT
GCAGTTGGTGTAGTAAACTTCAAAG 1577. chr10_KIAA1217_NM_019590_1.50407

Figure 3-129

TACCACAGGGGCTGTAAGACCTAGTGACCCTCCTAAGTGGGAAAGAGGAA
TGGAGAATAGTATTTCTGATGCATCAAGAACATC 1578. chr10_YME1L1_NM_139312_-1.57523
AAGATATGTTTTGCTCGTTCATAT 1579. chr10_ARMC4_NM_018076_-1.83283
AGTTTGGTGATACCCCCGTGCTGCCTCAC 1580. chr10_EPC1_NM_025209_-1.52769
AAACGGCCCCGGCCAGCGGGATCATGGAGAACCGGGGGTTCGGTCCCCAC
TCGCCAACCGCTGCCGGG 1581. chr10_PARD3_NM_019619_1.60548
ATAGGTCCGCCGACGATCTTCTACATCTTCATCTTGCTTTGCTTGCTGAA
ATTCTTGCCTCAGACGCTGTATCCGATCATGATTGCTAGGAG 1582. chr10_CCNY_NM_181698_-1.70166
GAAATCGTGCAGTGAACCTGTCCCCTCCGGTCACAACATCAAGAGCTGAA
CTGGGACTAGAAGTCATCGCCCCAGAGCTTTTTGCTA 1582. chr10_ZNF248_NM_021045_1.55149
TCCCTGATGGATAATGAAAGCTGAATTGTCACAGAAGATTTCCCCATATT
CATTATATTCATAAGGATTGTCCTTTGTAAGAGCTCTCTGATGTCCAAAC
CTTAAATTCATGCAGAAGGACTTCCCGCAAATACTGCATCCATACGGCTC
CATTTCCAAA 1584. chr10_RET_NM_020975_-1.7483
ATGTCAGACCCGAACTGGCCTGGAGAGAGTCCTGTACCACTCACGAGAGC
TGATGGCACTAACACTGGGTTTCCAAGATATCCAAATGATAGTGTATATG
CTAACTGGATGCTTTCACCCTCAGCGG 1585. chr10_HNRNPF_NM_001098208_-1.74941
TCAGGGTGGGTGTCAGGTGATCTTGGGTGTGGCTT 1586. chr10_LOC439911_AK127450_1.55195
ACCATGGATGGCCTATTATTATTAT 1587. chr10_ZNF485_NM_145312_-1.60204
CTAATTACTCAGTTGGAGCAAGGGGCAGAGCCCTGGACTGAGGTGCGAGA
GGCTCCATCAGGCAC 1588. chr10_C10orf10_NM_007021_1.59324
AATGCCACCACAGGACGTATGAGTTGTAGCCAGCAGAGTGCCCCAGTGGT
GCCAGGTGACAGTCCCCCGGAATACATTAGTGCATTTGCTAAGACTCCAT
GTGTTCTCTTGGGCCTCACAGAACATGGGCTTTGAGGGTGGGAGCCAAGA
GGCAGACTTGGGAGTGCCCGAGGCCTTGTTCTGAAACACCTGGGGGGCTG
ACACCCCCACTACCCTCACACCCCTACCACCAGTTTCCCCACCAGCGATG
ATGGTAGCTACTCAGCCAGTGGGCTCCTATATGCGGTTACACGTCAGAAT
GGCC 1589. chr10_ALOX5_NM_000698_-1.69909
CACCGACTGCCAAGGGCGTGGTGACCATTGAGCAGATCGTGGACACGCTG
CCCGACCGCGGCCGCTC

Figure 3-130

1590. chr10_WDFY4_NM_020945_-2.52241
TGCATCCCGGGGTCGTGTGCATCATG 1591. chr10_FAM13C_NM_198215_1.66655
AGATGGAGCATCGTGGCGACAGCAGTGGGTTATCACCATCAGTGATGTGA
TAGAGCAGCCTGCTGGTCCCCACAGAGTGGAGGTCTTCTGGTGCACTGTC
GGCCTCATTCT 1592. chr10_ZNF365_NM_014951_-1.64175
GACATCTCCTCAAATAGGAAGCCCAAATG 1593. chr10_SIRT1_NM_012238_1.52124
TCCTCGATGTCCTAGGTGCCCAGCTGATGAACCGCTTGCTATCATGAAAC
CAGAGATTGTGTTTTTTGGTGAAAATTTACCAGAACAGTTTCATAGAGCC
ATGAAGTATGACAAAGATGAAGTTGACCTCCTCATTGTTATTGGGTCTTC
CCTC 1594. chr10_MYPN_NM_032578_1.52893
ACTCTCTGCTCATTGACCCACTCACTCAGCGCGACGCAGGGACCTATAAG
TGCATCGCTACCAACAAAACCGGGCAGAAT 1595. chr10_SRGN_NM_002727_-1.53443
AGAATCCAGGACTTGAATCGTATCTTCCCACTTTCTGAGGACTACTCTGG
ATCAGGCTTCGGCTCCGGCTCCGGCTCTGGATCAGGATCTGGGAGTGGCT
TCCTAACGGAAATGGAACAGGATTACCAACTA 1596. chr10_HK1_NM_033496_-1.70354
ACCACAACCTGACACTGGGCAAGATGGCCCACCTGTGGCATCCCAGGTTC
CTGCCCTGTAAAGAGGAGTCTGG 1597. chr10_C10orf35_NM_145306_-2.01764
TGCAGCCCATCAGGGACCCACAGC 1598. chr10_TYSND1_NM_173555_-1.93868
CACACGTGGTCTGCAGCATTACGGGCGTGCCATT 1599. chr10_TYSND1_NM_173555_1.54243
GCGTCGGTAAGCAGCAGTGGGCCGGCCACGTTGCTGAGCACCCCGCAGCT
CAGCGTGTTGAGAAAGATG 1600. chr10_NPFFR1_NM_022146_-2.97308
CGCCCATTCCGCAGCGGGAGGCGGC 1601. chr10_ADAMTS14_NM_139155_-1.63735
GGCATGTGTCACCCCCTGAGGAGCTGTGCCCTCAACCATGAGGATGGCTT
CTCCTCAGCCTTCGTGATAGCTCATGAGACCGGCCACGT 1602. chr10_CDH23_NM_022124_1.60452
GAGGTCTACGCCACGGACAAGGATGAGGGCCTCAACGGGGCGGTGCGCTA
CAGCTTCCTGAAGACTGCGGGCAACCGGGACTGGGAGTTCTTCATCATCG
ACCCAATCAGCGGCCTCATCCAGACTGCTCAGCGCCTGGA 1603. chr10_ASCC1_NM_015947_-1.54185
GTGTCTTTCTGCAATATCGTGAGGGAAGCCGAGGCCCTGAATCATCAAAG
AGA

Figure 3-131

1604. chr10_OIT3_NM_152635_-1.99702
ATCACAGGCACCTCCGTGTCACCCGTGG 1605. chr10_TTC18_NM_145170_-1.50631
AGCTCCTCCTGTCCGACGGGTAAGAGGAGGCCTTGGAGGAATCATTTCCT
T 1606. chr10_SYNPO2L_NM_001114133_1.61102
GCTTGGCCTATGGCCCCCGGAGTTTGAACAGTGTCCCCAGGAGAGAAGTT
GAGGTGCTCGAACCCCGTCTGGGCT 1607. chr10_CAMK2G_NM_172171_-1.74901
TCCATCCCCTCCACGAGGTTACCAAGGGCCTCAGGCT 1608. chr10_ZMIZ1_NM_020338_2.35344
AGCCTTGGAGGAGCACTGGCAGTT 1609. chr10_MAT1A_NM_000429_1.57429
CTTCGTCCAGGTACTTGGCCGGCACCACGGCCCTGATGACTTGCTCCTTC
AGGGCCCTGCGCATCTCCTCCAGCGTGATGTCTTCGTTGTGCTGCACAGA
GATGACGATGGTGTGGATGCGCACAGGGATGACTGCGCCA 1610. chr10_TSPAN14_NM_030927_1.93021
GGAGTTGTCTTCCTTGGAGTCGGGCTGTG 1611. chr10_CDHR1_NM_001171971_-1.65621
ATTCTCAGAAATCCTCCCTAGACCATTTTCCCTCTC 1612. chr10_RGR_NM_002921_1.64528
GCCCACTGGCTTCGGGGAGCTCGAGGTGCTGG 1613. chr10_GRID1_NM_017551_-1.65387
TCCCCCGGGCGCGCGGCTCATCCACCCGGGCCCGGGGCGAGGCCGAGGGC
AGCGCGAAGCGGGGAGGCG 1614. chr10_LDB3_NM_007078_1.61439
CCAGCTACAGTGAGGGCCCCGCCGCCCCTGCACCCAAGCCCCGGGTTGTC
ACCACTGCCAGCATCCGGCCTTCTGTCTACCAGC 1615. chr10_MMRN2_NM_024756_-1.533
GCACCTTCTGCTTGACCTGGTACACT 1616. chr10_CFLP1_NR_028492_-1.8177
AGGACTGCCGCTACGCCCCTTATGACGCCACCAAG 1617. chr10_PTEN_NM_000314_1.80698
GGTCTCTCCCCTTCTACTGCCTCCAACACGGCGGCGGCGGCGGCTGGCAC
ATCCAGGGACCCGG 1618. chr10_SLC16A12_NM_213606_-1.50877
TGACATGAGTAAAAAACTGTACTCTTGCTGCAAACAGCAACAGAGGCAAG
TCTGTGCCCATTCTTTGGTCAAAGATGAATAGGGAGACACCCGCTTAATG
TCTTCTTTCT

Figure 3-132

1619. chr10_FGFBP3_NM_152429_1.51836
GGCGACAGCGACGCTCGCAGCTTCGGAGGA 1620. chr10_PLCE1_NM_016341_1.51476
AGAGCAACCTCGAACAGTCATCAAAGCACCCCGCGTCAGCACTGCACAGG
ATGTCATT 1621. chr10_SORBS1_NM_001034954_1.58938
ATCGTCTATATTGAGGAGGTCCCCAAAGCGCTCATTAGTGATAAACTGAT
GGTGCGTCGGAATGACGCCTGTGTGGCGTCGAGCTGCAATA 1622. chr10_SORBS1_NM_006434_-1.97691
TGCATGGAAGTTGGAAGAATATAT 1623. chr10_BLNK_NM_013314_-2.16545
GTGAACCGGCCTGGTTTCCTGCTCTACTGGAGGCGGCTCGTAGCTGTCAT
CAGCGTTCTCCTCGGCGGGCATCACGTACATCTCTGAG 1624. chr10_DNTT_NM_004088_-1.56211
TGAGAAGAGACTATTCAGATAGCACCAACCCAGGCCCCCCGAAGACTCCA
CCAATTGC 1625. chr10_TLL2_NM_012465_-1.50536
CGTAGCCGTCGTAGGCTTCCATGTAGTCGTAGCCGCAGTCGGCCTCCTCC
TCAACCTCAAAGGTCCGGAATGTCAGCTCCACGCCGTAGCCGTCCTCTGC
CACGATCACCCAGTCACAGCGGGCCTCGCTCGGGTAGTTGTTGTCC 1626. chr10_TLL2_NM_012465_-1.56871
CACTTCAAACTGAAGGGAGATCCGGTACTGAGCGGGGGCCACCACCTGCC
AGACACAGTTTTTGTTTGTGGGATACTCCTTCGGCCACCCAGGGCTGGTG
ATGGTTCCATTCAGCTTGGTAATGAAACCGCCACAGG 1627. chr10_FRAT2_NM_012083_1.73937
ATGCGGTCAGGTCCGCTGCGGCCTCCCCCGGGCCCAGGGGCGCTTGCGGG
GCCCGTGGCTGCAACCGCGGCGACGGCTCGTTGGAGTCTCCGCACGGCTT
CCTTGATGAGGTTTCCCGAGAGCACGAGCTGCTGGAGGAGCCGATGCGGG
TCGTCGTCGCCGGCGCGTGCCCCGGCTTGGGTCCATCGGCGCTGCTGCAA
GCGGC 1628. chr10_MMS19_NM_022362_-1.64374
TCAGAAACTTGGTGACGAGGGTGTCCACGTGAAGACTCATGACTTGGGGT
GCTTCCAG 1629. chr10_HPS1_NM_000195_-1.82461
CACTCTGCCCTATCCTCAGGATGGCCACTGCAGACAGGAGGCTCTCGTCA
TGGGGAACAGTGGCAAGCAAGGGTGGCTGGAGGACAGGATGCAAAGGCAG
ACTGCGGCCACCTTG 1630. chr10_GOT1_NM_002079_-1.66834
AGGGTGCTGGCCACAATTCGTGCTCCCTGGGCGGGGGGATTGGACCAAGT
AATCCGCACGATCTTCTCCATCTGG 1631. chr10_NKX2-3_NM_145285_-1.54898
TGTTACCAAGCCCGGTCACCTCCACCCCTTTCTCAGTCAAAGACATTTTG
AATCTGGAGCAGCAGCACCAGCACTTCCATGGTGCGCACTT

Figure 3-133

1632. chr10_ENTPD7_NM_020354_-1.56908
CAGGTCTGAGTCCCGACAATCCATTTCTGGATCCCTGCCTGCCAGTGGGA
CTCACAGATGTGGTGGAGAGGAACAGCCAAGTCTTACATGTCCGAGGAAG
AGGAGACTGGGTGTCTTGTGGGGCAATGCTGAGCCCCC 1633. chr10_COX15_NM_078470_-1.68126
AGCAGACGAGGCCACAGAGGGCAAGAACACGTCCTTTCATGCCACGGCTG
AGCCAGCCCTTTCTCCAAAAGTAGGCAGCAGGCAGGATGTACACAAGGCC
TACAAGGCGACCCCACATTCGGTGTGAGTACTCCATGTACCAGATGAACT
TGA 1634. chr10_PKD2L1_NM_016112_1.74124
CAGGTGCCCACTCTCAGCTAGAGGAAGAGGGAGCAGAGGCACAGCCCAGC
CTAGCCAGCAGAGAGCAAATGGAAAGGCGTCTGAGAGCAGCTGTTTCCAC
ACAGCCTGGGCTCCTGCCTTTTGTAGGGGGATGTCTGTGCCTGCTGGGGA
GGGAGCGGATGAGAGGACAGGGTGGGGAAGGACCATCAATCCTGTCAGGA
G 1635. chr10_FAM178A_NM_018121_1.51677
ATTCTTCTTCATTTAGTCGGTGAAGTTAGTTGTT 1636. chr10_LZTS2_NM_032429_-2.06102
TCAGCTGCTGACAAACCCCTGGCATTTAG 1637. chr10_PDZD7_NM_024895_-1.51034
AAGGTCAGATAGCTCTGGGAGCGCGTGATGGGGGGCCGGGGTCGGCTGAG
GGCCAGCAGCAAAGCCGTCTTGGGAGACTCAGAGAGCGCAGAGTCAAGGC
GGCGGCCGGGATGGGGGCCGTCCGAGCGGATGGCGGTGTCCCTGAGGATG
ACTGTGGGCCGCACGCTGCACCAGGTCTCCACCCGGCCTCCCGCATCGGG
CTCCGTCTGCATGGCTGTGTCCGCCCGCCCCCAGCCTGGGCCGCGGCTGC
CGGGCTCCTCCTGCCCGAGGCAGATGTCCATGCGGTCCGACGGCAGGGAG
CCCGAGCTGTAGGGGGCGCTGGAGGCGCACGAAGAGACGCTGGAGCTGCT 1638. chr10_BTRC_NM_033637_-1.61429
GGATCCGGGCGCTGCGTTGGCTGCGGCCTGGCACCAAAGGGGCGGCCCCG
GCGGAGAGCGGACCCAGTGGCCTCGGCG 1639. chr10_POLL_NM_001174084_1.54158
CCCAGCTCCCCAGATGTTGGAGAAGAGCTCCAAGACAGGCACGCTCTCAC
TGATATGGTCCAGCTTCCGCAAATGCCCGCTCTCCAGGATCTCTATGATT
TTCTCAGCC 1640. chr10_FBXW4_NM_022039_1.54426
CGGCAGCGCCCCAGTCTCCAGTTCTGAGACACCTTCACTCGTTCCTTCAC
TGG 1641. chr10_KCNIP2_NM_014591_-1.93736
CCTGGCGGCCTACTGTGCTGTCGGGGCTGGGGAAGTCCGGGCTGAGGCTG
AGTCTGGGAATGGGCCCGGGGTCTGAGGTCTACCCGGAGGTCCTGGAGCA
GGAGAGGGAACACTAGGCAGCAGGTGAGCGCAGAGCCGGAGGCAGAGCGG
ACCTGAGCGCGGAGCCGAGCCGAGCTGCCTCTCTCCTCCCGCCCCCTCCC
CGCGGCTGTCACCGCCTCCTCCCCTCTTTGGCGCTGCCGGGATTGGCT 1642. chr10_INA_NM_032727_1.51108

Figure 3-134

TGAGCTTCGGCTCGGAGCACTACCTGTGCTCCT 1643. chr10_TAF5_NM_006951_1.93853
ACGCTGCTACCTCCGCAGGCGGGGGACGGCGCAGGCGAGGGTAGCGGCGG
CACTACCAACAACGGCCCCAACGGCGGCGGCGGGAACGTTGCGGCGTCGT
CGTCCACTGGCGGGGATGGCGGGACCCCCAAGCCCACGGTGGCTGTCTCC
GCCGCTGCCCCGGCGGGGGCGGCCCCGGTGCCCGCCGCTGCTCCGGACGC
CGGCGCTCCGCATGACCGAC 1644. chr10_CALHM1_NM_001001412_1.52347
GAACTCAGGTGTGCCTGACCCAAAGCTTTGCTCTTCATCACATTTGTACC
TCCTGATACCTCCGGGCCTTCTCTTCCCACTGGAAGTGCTGCCACCCACC
AACATACACCTTGTTTTTTGCTCATCCTAATCCTCCCTGACTTCAGGGCC
CATACCAACTCCTACCTCCTGGAAGAGCCCTCCCAGCCCACCTTGGCCCA
CAAAGATCTGAGCAACTCCTCCCAAATAATTAAGAGGAGGGAAACTGGAC
CCCAGAAGTGGGAATAGAGGGAAGGATGGATAAAAAAGGATGGAATCATG
CCAAGATCAAAATGAATCCTTAGATGCTTGGGACTTATGTCTCAGAGCTG
AGGGCGGTGCTGAGAAACCTATCTGTA 1645. chr10_SH3PXD2A_NM_014631_-1.73104
ATTCTCTGCGTGGTGGAGGTCTTGTCCGTAGGTTC 1646. chr10_OBFC1_NM_024928_1.5962
AGTCCTGCTGAATGATCCGGTGGATCTTTCTGTGCAGG 1647. chr10_C10orf79_NM_025145_-1.58854
GACTTCCAGAACTCCTCCCATCATGTCCA 1648. chr10_GSTO2_NM_183239_-1.52891
AGCGGTGGCGAGCCACAGGGCGGCGACCGTGAGCTCCGGGAGCTGCGCAA
ACCACCTGGAGA 1649. chr10_DUSP5_NM_004419_1.58241
AAGGTCACGTCGCTCGACGGGCGCCAGCT 1650. chr10_ADRA2A_NM_000681_-1.81702
CTGGCCGTGGTCATCGGAGTGTTCGTGGTGTGCTGG 1651. chr10_TCF7L2_NM_001146274_-1.75844
CGGCTACCCCTTCATCATGATCCCCGACCTGACGAGCCCCTACCTCCCCA
ACGGATCGCTCTCGCC 1652. chr10_NRAP_NM_006175_-1.53161
AGGTCCTCGGGCAGTGCTGTGAACTTGTGATACTGTGTCCTGTAGTCGTG
GTCGCTGGCCAGAGCCT 1653. chr10_ADRB1_NM_000684_1.59948
TGAAGAAGATCGACAGCTGCGAGCGCCGTTTCCTCGGCGGCCCAGCGCGG
CCGCCCTCGCCCTCGCCCTCGCCCGTCCCCGCGCCCGCGCCGCCGCCCGG
ACCCCCGCGCCCCGCCGCCGCCGCCGCCACCGCCCCGCTGGCCAACGGGC
GTGCGGGT 1654. chr10_TDRD1_NM_198795_1.62918
CAGGAGGGCGCACTGGGGATTGGAGGCGAGGGAAGTGCAGGGCGCATCCC
AGGCGGCAGGGCTCCCAGCATCGGCAGTCGCCAT

Figure 3-135

1655. chr10_FAM160B1_NM_001135051_1.56598
AATCTTGGGCCTTGGATCAACTGCCCACCCTTGAACCAATCCTGGTGGCC
CCAGGCTGATTGGCAGACCTGAATCACCTATCCCATGCCCAGAACTTTGG
CTTGACCAGGCTCATCCAAAACAAGGG 1656. chr10_ATRNL1_NM_207303_1.52664
CTTCGAGAACGACAGCAGATGGCCAGCCGTCCCTTTGCTTCTGTTGATGT
AGCTCTGGAAGTGGGAGCTGAACAAACAGAGTTTCTGCGAGGGCC 1657. chr10_GFRA1_NM_005264_1.54844
TAATTCGTCTTGCAGGAGTCCTGCAAATTCAAACAGTTGGGCTTCTCCCT
CTCTTCATAGGAGCACACAGGCACGATGGTCTGTCGCCTCCGCTCTGTGC
AGGCGATGTCCCGGCAGGAGCAGAAGAGCATTCCGTAGCTGTGCTTGGCC
GGGACCTTGTCAAAGAACTGCCGGAGGGCCTTGTGGCACTTGCGGCGGTT
GCAGACATCGTTGGACACGCTGGTGGTGCACGGGGTGATGTACGCCGACC
TGTACTTCTTGCAAATGTCGTCGAGGTTGCAGGCCT 1658. chr10_PNLIPRP2_NM_005396_-1.50573
GTCCCGGGCAATGTACACCCAAGCCGTGCAAAACATTCGGGTTGTTGGGG
CGGAGACAGCTTTCTTAATACA 1659. chr10_RAB11FIP2_NM_014904_-1.5263
AGATTGATTGCCACCTGCCCTAAAAATTTATCCAGACCCACCAGGGACCT
GTGCATAACTATAAGGAAAAGAATGTATTTCTCTGGACTTCCCTGAATTA
GCAATCCAGGTAGCTCGAAAGAGGCCTCCTCCTTCCAAACTGGCTCAAGG
GTTTTCTCAGCTACAGAGGTGGAGTACTTTTCCTTGCCCAGCTGAATTAT
AGTGTATGTGTCATTGGTACCACTTTTGCCTTTTGGCTTCAGATCTTTGG
CTTGGAGCACTGTGACCTGCACGTGGGTTGGAAACCACTTTTGGGCTTGC
TCGGACAGCA 1660. chr10_EIF3A_NM_003750_-1.66764
ATCTGAGTGGAGGTCCTCTTCGGTCCCTGTCGTCTCTTAGATCTCGTCTT
TCTCTTAGATCACGCCGGTCA 1661. chr10_GRK5_NM_005308_-1.50573
GTGCAGCCACTGTTAAGCCATGTGTTCCAAGGCATTTTAGCGGGGAG 1662. chr10_INPP5F_NM_014937_-1.75138
AGAAGGTGTTATTGGGAAAATTCA 1663. chr10_SEC23IP_NM_007190_-1.51002
AGAAAACCTAACGGTGGCAGCGGCGGCGCCTCCACTTCCTCATCCGCCAC
TAACTTACTTTTCTCCTCCTCGGCCACGGAGTTCAGCTTCAATGTGCCCT
TCA 1664. chr10_TACC2_NM_206862_1.57467
TCAGTCTCCCACCAGACGGTGCAGCAGCTGGTTCTGGAGAAGGAGCAAGC
CCTGGCCGACCTGAACTCCGTGGAG 1665. chr10_FLJ46361_NR_003570_1.58816
TGAAGAGAGATGAGCTACCCACACCTTCTATGTCTT 1666. chr10_PSTK_NM_153336_-2.49907
TGAAGACCGCCGAGAACATCAGAG

Figure 3-136

1667. chr10_PSTK_NM_153336_-1.75455
GACCATCCACCTGATGGGAAGAAAGCTAGAAAAGCCCAACCCTGAGAAAA
ATGCTTGGGAACACAACAGCCTCACAATTCCGAGTCCAGCATGTGCTTCG
GAGGCCA 1668. chr10_METTL10_NM_212554_-2.01
CCTGGACGGCCGTTGGGGCCGCCAT 1669. chr10_CTBP2_NM_022802_1.55069
GCCTCCGCAGCTGCATTTCGGTCCTGCA 1670. chr10_DPYSL4_NM_006426_-1.57334
TCGTGTTTGGGGAGCCCATCACCGCCAGCCTGGGCACCGACGGTTCACAC
TACTGGAGCAAGAACTGGGCCAAGGCCGCAGCCTTCGTCACATCACCCCC
TGTCAACCCAGACCCCACCACGGCGGACCACCTCACCTG 1671. chr10_C10orf93_NM_173572_-1.61758
ATACTGTAGCTGTCTGCAGGTAACAAACTGCAGAAAGTGAACTGCGGGTA
ACGAGGCACTGCCGGTGTGATTTACACGTCCAATAATGGGACTGGTGGAG
GATGTTCTGGATCATCAGCATCATGAAATTTTACGCCGTCCGTAA 1672. chr10_KNDC1_NM_152643_-1.84703
GGCCCTTCCGGGAGTACGAGCTGTGGGCCCTGTGCCTGGCCTGCCTCCGC
GCACTGCAGACACGCCCTGAGCACCCAG 1673. chr10_KNDC1_NM_152643_1.70014
CTCCAGCGAGGCATGGACAGCCGGAAAATCCTTGCCCACCTCAGAGCTTC
CATCTGCC 1674. chr10_KNDC1_NM_152643_1.77961
GCTTCAGCGGTGCCGACATTTCCACACTCGCCGCAGATAGCAGGGCCAAC
TTCCACCAGGTCTCCAGCGAGAAGCACTCACGGAAGATTCAGGACAAGCT
ACGGAGGATGAAGGCTACATTC 1675. chr10_VENTX_NM_014468_-1.51491
GCATCAAGGAGGCCGCCGGGTCCTCAAATCTGC 1676. chr10_ADAM8_NM_001109_1.59171
CGAAGCGTTCCTGGCAGCGGCAGCCCTGGACGTTCTCATCATGGTCCATG
CCCAGGTTGTGGCCCATCTCATGGGCCATGGTACAGGCCACGC 1677. chr10_ZNF511_NM_145806_-1.98709
ATACCCTCTACCATCTGCTTTGGTCAGGGTGCCGCTCGAGGATTTAAAA 1678. chr10_C10orf125_NM_001098483_-1.82831
CCGTGCCCCATCCGCGCCAGCGCGTAGAGCAGCTCGGGGGACAGC 1679. chr10_ECHS1_NM_004092_-1.57035
TGCTTGCTTGGCGTCCTGGGCTGAGATCCGGTCACCAGTGAGGACCATCT
CCATCGCCAGCGACTTCCCAACAGCACGGGTGAGTCTCTGGGTGCCGCCC
GCAC 1680. chr10_PAOX_NM_152911_-1.76867
AGCTGGCTGCTGAGTACGGGCTGCTGGGGGAGAAGGAGCTGTCCCAGGAG

Figure 3-137

AACCAGCTGGTGGAGACCGGGGGTCACGTGGGCCTGCCCTCCGTGAGCTA
CGCCAGCTCCGGGGCCAGCGTGA 1681. chr11_B4GALNT4_NM_178537_-2.14147
AGACGAGGTGCAGCGCCGAGCCTTCCTCTT 1682. chr11_PKP3_NM_007183_1.87529
ACGGTAACTTCCTGCTGTCGGCCCTG 1683. chr11_PKP3_NM_007183_1.62285
CCCTCAGCAGTCAAGTACCTCATGGCTTCAGACCCCAACCTGCAGGTGCT
GGGAGCGGCCTACATCCAGCACAAGTGCTACAGCGATGCAGCCGCCAAGA
AGC 1684. chr11_PKP3_NM_007183_-1.5604
GTGGAACCTTTCATCCAGCGACCACCTGAAGGACCGCCTGGCCAGAGACA
CGCTGGAGCAGCTCACAGACCTGGTGTTGAGCCCCCTGTCGGGGGCTGGG
GGTCCCCCCCTCATCCAGCAGAACGCCTCGGAGGCAGAGATCTTCTACAA
CGCCACCGGCTT 1685. chr11_SIGIRR_NM_001135054_-1.64299
CATCCTTGGACACCAGGCAGTAGAAGTCTGTGCGGGCACTGTAGTTTCGC
GAGCCGAGATCCGAGACGTCCACTTCGCTGCTCCGGCTCTCTCCCAGCGA
GACCCCACTGGTGTGCGGTGGAGCTGATGGCTCTCCAAAGACAGGCCCC 1686. chr11_LRRC56_NM_198075_-1.73478
CTGCCCAACCTGGACCAACTGAAGCTG 1687. chr11_C11orf35_NM_173573_1.5999
TGTTTTCAGAGAGGTCGCTTGGGTCCATCAGAGTCTCTG 1688. chr11_IRF7_NM_001572_-1.6864
GGTGTCACAGTTCCGAGGCAGCAGGCAGGCTGGGGTGGAGGGGCTGGCGG
AGCCTGGGGGTCCGCCCACCTCCCAGTACACCTTGCACTTGCCCATGCGC
CGGGCCCACAGCTGTGGCCCCCGAAGCTCCAGGTGCAACCCAGGGGCCAC
GTGCCGCAGCAGTTCCTCCGTGTAGCGCAGCTGCTTCTGGTCCGGGAGCT
CGGCAGGGCTGGGGAATGCTACCTGCTGGGGGTCTGTGGCCCGGACAGCT
GGGTCTGGGGGGCCGTATAGGAACGTGCAGCTCGGGT 1689. chr11_CDHR5_NM_021924_-1.60791
GGTGTTTGAGACCACCGGCTCCCAAGTGCGTCGCCTTGGGGGTTTGCATC
GGCTCCTCAGCCTCCCCAGGCAATCTCTGTGTAGGGTCGGGAGCGGGAGG
TCTGAGATGAGCCCGGGTGCCTGAGATCTC 1690. chr11_CDHR5_NM_021924_-1.96419
GGGCATCGGCTGAGAGGTTCCTGCCT 1691. chr11_SCT_NM_021920_-1.6198
TGCAGGATGGGCATGTTGGACCCTGACGGGCAGAGCAGACCCGCGCT 1692. chr11_EPS8L2_NM_022772_-2.06692
TTTCCGCCGTCGGGAGTCGCAGGAG 1693. chr11_EPS8L2_NM_022772_1.71556
CGGCAGTGGTGGAAGCTGCGCAGCCGCAGCGGCCAGGCGGGGTACGTGCC

Figure 3-138

CTGCAACATCCTAGGCGAGGCGCGACCGGA 1694. chr11_LRDD_NM_145886_1.6019
GGCCAAGCCCATGCGTCGGATGCTGTCCTGGTAC 1695. chr11_LRDD_NM_145886_2.21766
CAGCTGCACGGTGACCGGTTGGAGGAAGCTGGGGGGACCGCTCTGTGACA
GGCACAGCAGGGGGCTCACTGCAGCCTCTGGTTCTCCCAGGAGGGCCTGC
AGCTCTCGGCCAGCCATGCGCACCA 1696. chr11_KCNQ1_NM_000218_-1.60969
CTGGAAGTGAGCATGCCCCATTTCATGAGAACCAACAGCTTCGCCGAGGA
CCTGGACCTGGAAGGGGAGACTCTGCTGACACCCATCACCCACATCTC 1697. chr11_SLC22A18_NM_002555_-1.69507
CCCGGATCAACTGGACTTTTGCCCCCTGCTCCGCCA 1698. chr11_SLC22A18_NM_002555_1.70448
GTGTTCGACCTGAAGGCCATCGCCTCCCTGCTGCGGCTGCCAGACGTCCC
GAGGATCTTCCTGGTGAAGG 1699. chr11_OR52A4_NM_001005222_1.82938
TATATGGGGAATACATGTATTAAA 1700. chr11_HBE1_NM_005330_1.74107
ACAGAAGGCTTTCTCTCAAGGCCA 1701. chr11_OR52B6_NM_001005162_-1.50362
TGCTGATGTCTTGCTCTCTACCACCAC 1702. chr11_FAM160A2_NM_032127_-1.52192
CCAGGCTGAAGGACCAATTGTGCCGCCTGCCGGGCCCTGGTTGGACTGTG
TGCATGCCGCAGGAGTAACTCCC 1703. chr11_APBB1_NM_001164_-2.55423
GGGAAGGTCAACGTCCCCTCCTCA 1704. chr11_CYB5R2_NM_016229_-1.65883
CCAGCAATCATTCCCAGGTGATCGGCCAGTGTTTTTTTAGGCTCACTCGT
CTGGTCTGGTCTGATTCCAAGATTCC 1705. chr11_RPL27A_NM_000990_-1.51299
CCTGGTGGCTCCATCGGCCGCGTTCATCAGTCAGCACGACCCGACCTCAG
TGGCGTCCTCACAACACAGACCGGACCTTGGGTCTT 1706. chr11_AMPD3_NM_000480_-1.68106
CCTCCCTGCTGAGGCGGCCCTCCCTCCTCCCGCGGGGCCCTCCTGGCCGG
GGATCCGCAGCGCTGCGCCCTCTGAACGCCCGGCCCCCGCGCCTGCTGCG
GGGCGCGGCCTGGCCGGGCCCTGGCCCCGGCTGGCCTCAGTGCCCAGCAG
CCCCGCTCCGCTCTGCCCAGCGCGTCCCCTTTGCTCCA 1707. chr11_MICALCL_NM_032867_-1.51302
GCCCAATCGGCCATCCAAGGTCTTTCCTGCA 1708. chr11_MICALCL_NM_032867_-1.81435

Figure 3-139

GATTGAAGATGTCCCCACACTCCT 1709. chr11_PDE3B_NM_000922_1.50196
GCGACACTGAGTCTCCAGTCCCGAGAGGTGCCCGAGGGAAAAGGAGGCGG
CAGCTAAACTGGTCCTGGAGAGAA 1710. chr11_PDE3B_NM_000922_-1.51176
TTGAACAGGAAGTATCACTGGACCTGATTTTAGTAGAAGAGTATGACTCA
TTAATAGAAAAGATGAGCAACTGGAATTTTCCAATTTTTGAACTTGTAGA
AAAGATGGGAGAGAAA 1711. chr11_SOX6_NM_017508_-1.52522
CAATGGGGCTAGGGATGCTGCTTTTGTTTGGCAGATTGACAGGGCTGGTT
TTGCTGGCTGGGAAGAGGTTCTGGGTGGGAGACGTTGGGGACTTTACAGG
CTCTGCTGTCTTGGGTCGGGATGAGAGATTCAGA 1712. chr11_RPS13_NM_001017_2.63185
GATCTGTGAAGGAGTAAGGCCCTT 1713. chr11_MYOD1_NM_002478_1.57584
GGCGACTCCGACGCGTCCAGCCCGCGCTCCAACTGCTCCGACGGCATG 1714. chr11_---_---_-2.95742
AAATAGCAGCCACCGCTCCCTGGCA 1715. chr11_GTF2H1_NM_005316_-1.52756
CTTGTTGTGAGTCAAGTGATCAGT 1716. chr11_UEVLD_NM_001040697_1.5265
AGGCCGGTCCCGAGCTAGGTCCCAGGACTCC 1717. chr11_SPTY2D1_NM_194285_1.65377
AACAGGTTTGTCGTGGCCCTCACGAAGTGAGGGTTGGGAGCTATTGCCAG
ATCCTGCCTTGATCCTCTCTCCTGGCATGGATTTGGATGAAGACAAAGCG
AGGTGTTTCTCATTGGCCATGCTGGGTCTTGATTTCTTCTCAGCATGAGG
AAGGGGCATTCCTTTGGAAGAAGGATGCCTGTCTCCAGAACCTTTGCTAA
GTTTTGTGCCCACACTTTCTTTCTGAGAGGGTGCCTTTTTGGACACAGTT
GGAGGTAGTTTTCCATCTGTCTCAAGTTTTTTTCTCCTATGCTTTCGTTC
AAGGAATTCTCGCTCCCTAAGTTCTTCTGCGGTCATAGGTCGCTCTTCTG
ATTTCTTCACTACCTTGATTTCCACTGGTTCAAACTGCTTTTTCTCAGCC
AGCCTGAGTAAATCAGTGAAGTTCATGGGTGGTGGGGCACTTTTAAGGGG
GACCTTTGGTTTGCTTTCAACTTTGGGAGGTTCTTGCTCTTCCTCATACT
CCTGCTCTGACTCTGCGTGATTGTACTCGAGGAATTCATTCTCTTCTTCC
ATTTCATACTCTCGGTCGGTTCCTTGGCTGG 1718. chr11_NAV2_NM_182964_2.32863
CAGCAGGTGCCAGTCACTCCCCAAGC 1719. chr11_NAV2_NM_182964_1.62677
GACCCGCACCTTGATAGGAACACTTTGCCT 1720. chr11_LUZP2_NM_001009909_-1.54861
GAAAGAGCAAAATGATCCGAGACCTCCAGAATG 1721. chr11_KCNA4_NM_002233_1.62111

Figure 3-140

AAGCTGCTCTGCCGGTAGTGGGCTTTCTTCT 1722. chr11_PRRG4_NM_024081_-1.50055
TTGTCTCCATTGCCGCCTTCTGTGGAGGATGCAGGATTACCTTCTTATGA
ACAGGCAGTGGCGCTGACCAGAAAACACAGTGTTTCACCACCACCACCAT
ATCCTGGGCACACAAAAGGATTTA 1723. chr11_PRRG4_NM_024081_1.69674
AAAAATCTATGTCTCTCCCATCTCAC 1724. chr11_SLC1A2_ENST00000395750_-2.16516
CTGACATCTAACCTCTCCTCCCTG 1725. chr11_PRR5L_NM_024841_1.56959
TGTGCGCGACTCGGGGTGATTCACGCCGGGGA 1726. chr11_PRR5L_NM_001160167_-1.53357
TGACCCGCGGCTTCGCTCCCATTCTGCCCGTCGAGTTCCACAAGATGGGC
TCCTTCCGCAGGCCTAGACCGCGCTTCATGAGCTCCCCCGTGCTCAGCGA
CCTTCCCCGATTCCAAGCAGCTCGGCAGGCTC 1727. chr11_EXT2_NM_000401_1.55382
ATGTCCTGCGCCTCAGGGTCCGGTGGTGGCCTGCGGCATCCCTTGCGGTG
CCAGAAGCCGTGGGACGA 1728. chr11_CD82_NM_002231_1.54902
CGCAGTGATCCTGGGCTTCGGGGTGTGGATCCTGGCCGACAAGAGCAGTT
TCATC 1729. chr11_TSPAN18_NM_130783_-1.81885
CTCCTGGACCACCCTCAAGCTTCAG 1730. chr11_TP53I11_NM_006034_-1.97715
CAGATGGGGGATTGAGGCTTCGGCCTGAGGGCACTGCCCATTGGCGGCAC
CACCTGTGGG 1731. chr11_SYT13_NM_020826_-1.56586
GTGCCACATGGCAATCTGCCGGCGAGGGTTTTTGAGCA 1732. chr11_PEX16_NM_004813_-1.73297
CTGTCCAGTGGAACGATAGGGGGTGAAGTCTGGAGGCCAGCCTTGAACCA
GAGCAGCAGGAGCATCCGCAGTACAGCC 1733. chr11_PEX16_NM_004813_1.8836
TGGCCAGCTGGACGAGGGCGATGACAAGCCAGCGGCCCACTTCACCCCAC
ACCTTGGCAGCTCCCATCTCCATGAACACCTCCACGCACTCCAGCA 1734. chr11_AMBRA1_NM_017749_-1.65883
TGGATGCCAGAAGAGCGGGAGGACAGCATGTGCAGGAAATTGTGGAGGAG
AGGCGTCCGGCGAACTGGCTGTGATTGCAGGAGGGCACGCTGACGGTAGT
GGGATAATTCTGTTCCATCTATG 1735. chr11_ARHGAP1_NM_004308_1.69754
TGCACTTCCCGGACCACTTGGGTGTTGGCCGACCTCCGGAAGATGCCCTC
GGTGGTG

Figure 3-141

1736. chr11_PACSIN3_NM_016223_-1.6357
TGAAGAAAAGAAGCCGCTGGCGCTCGGCGGCCTGGCAGGTCTCAAAGGCC
TGTTCCATGTCCTCCATGTAGCGTGGAGTGTAGCGATGCAGCTCTGCCAG
CGTCTGCTCATACTGAG 1737. chr11_PACSIN3_NM_016223_1.59676
GCGTTCCACCCGTTCCTGCAGTTTGCGCAGCTGCTCCTGGGAGACGGCGC
TGTCTGCCTTTGCGTGGCTCTCCCTCGTCTGGGCGGTCTTCTCATCCTTC
CGGGCTGCGTGGTAGCTTTTCTTGGAA 1738. chr11_MADD_NM_130470_1.53854
ATGCAGAAGTGCTGCCTATCCTGCCAGAACCAGAATCACTAGAGCTGAAA 1739. chr11_MADD_NM_130470_-1.78974
ACAGCATGGAGCGCGCTGCCGCCCGACAGCAAAGCATCAA 1740. chr11_OR4C12_NM_001005270_-1.74792
AGTGTGTAGACCACGGGATTTAACATTGGGACCACCATAGTATAAAATAC
AGCAACAGCTTTATCAATGGGCAGAGTGGTCACTGAGCGCAGATACACAA
ATATACAGGGCACAAAGAATAAGACAACTACTATGATGTGAGAAATACAG
GTGGAGAGGGCTTTACACCTCCCCTCCAAGCTATTGTTC 1741. chr11_OR5AS1_NM_001001921_1.64401
TAAATCGTTTAAGAATAGTCAATA 1742. chr11_TNKS1BP1_NM_033396_-1.54077
GCTGCCATAGGTGCCGAGTGACACATCTCTCTTCTGAAACTCCCAGTCCT
GCTCATCGGCATCCTGGCTGCTGTACCTACCATGGTGGTCCCTCTTCCCC
AAATCTTGGCCCTGCTCGTTGGCATCTTGGCTGGCATAAGCACCCAGAGA
ATCTCTCTTCCCAAATTCCCAGTCCCCAAGGCTTACATCTCGACTACTGT
AGGTACCCAGTGAATCTCTCTTTCCGAATTCCTGGTCCTGGAGTTCTGCA
TCCCGGCTGGAGTAAGTGCCCTGGGAATCC 1743. chr11_TNKS1BP1_NM_033396_1.50036
CCTCGTCAGGCAGGGCTGCACTTGGAGCTGATGGAGTCACAGCGGGGCAG
GGAGAAGCCTGGGAAGCTTCAGGAGTCTGGGCTTCCAGAAGCTGTGAGTG
GCAGGGAGAACTCTTATCAGGCGGGT 1744. chr11_SLC43A3_NM_017611_-1.5322
TCTCTCCCAGTTTCACACTCCCAGAGC 1745. chr11_RTN4RL2_NM_178570_-1.7762
CTTGTTCGCGGACCTGGCCAACCTGAGCCACCTCTTCCTCCACGGGAACC
GCCTGCGGCTGCTCACAGAGCACGTGTTTCGCGGCCTGGGCAGCCTGGAC
CGGCTGCTGCTGCACGGGAACCGGCTGCAGGGCGTGCACCGCGCGGCCTT
CCGCGGCCTCAGCCGCCTCACCATCCTCTACCTGTTCAACAACAGCCTGG
CCTCGCTGCCCGGCGAGGCGCTCGCCGACCTGCCCTCGCTCGAGTTCCTG
CGGCTCAACGCTAACC 1746. chr11_SLC43A1_NM_003627_1.57846
CCTGGCCACCAGTCACAAGGTACTCCAGCATCTTGTTCACAGCAGCCATG
TAGAAGATGATCCGCAGCTGGGTCATGCCCATGGTGAGGAGGCTCCACAG
GAAAGTGGGGGAGCAGAGGCTCTTGCGTAAGGGGACAGACC

Figure 3-142

1747. chr11_SERPING1_NM_000062_-1.94349
GGCCGTGTTGGGGGATGCTTTGGTA 1748. chr11_ZDHHC5_NM_015457_-1.60695
CCCGGCACTGAGGGCAACGGCCGCGCGCCGGCTCCGAGACGAGCGACGCC
TGGCGGGAGCGCG 1749. chr11_ZFP91_NM_053023_-1.50779
AACAACGGCCCCCTGAGGCGGTCGCGG 1750. chr11_GLYATL2_NM_145016_1.64626
GCTTCTTTCCCTCAAGAAGATGAT 1751. chr11_MRPL16_NM_017840_-1.53442
CGCAGGAGCGGCGCACTAGCGCGAGCCAGCA 1752. chr11_GIF_NM_005142_1.53304
CTTCAAGTTGTAGGCTCCGGCCAGATTCATGGCAATCAGGATGCTGGGGT
TTGGGTAGGCTGATGAAGTCACCGAGTTCTCCATGAGTACTTGTATTCCA
TTGACCAAGGGCTCCTGT 1753. chr11_CD6_NM_006725_-1.83003
CGCCGAGGCCGTGTGCCGAGCACTGGGCTGCG 1754. chr11_CD6_NM_006725_-1.5572
AGCAATAGCTATCAACCGGTCCCCATCACCATC 1755. chr11_DAK_NM_015533_1.52623
GGGGACGCTCCTTATCGTGAAGAACTACACTGGGGATCGGCTCAACTTCG
GCCTGGCCCGGGAGCAGGCCCGGGCTGAAGGCATCCCGGTGGAGATGGTG
GTGATTGGGGACGACAGCGCCTTCACTGTCCTGAAGAAGGCAGGCCGGCG
GGGGCTGTGCGGCACGGTGCTTATACACA 1756. chr11_CPSF7_NM_024811_-1.51165
GGCTCCCGGAGAATCAGAAACTCATACGTTTTCTTGGACAAAGCACCATT
CTCTATGGAGACCAGGGGCCT 1757. chr11_C11orf66_NM_145017_1.5669
TGGCCAGAGGCTCCAAGCGGGAAACAGCCTTCAGCCGAGGGAATGAAAGG
A 1758. chr11_C11orf9_NM_013279_-1.88897
TGGAGAATTCGATGTCCATCACCTCC 1759. chr11_C11orf9_NM_013279_-1.72821
AGCCTTCCACAGAGTCTCCACACCCACCAG 1760. chr11_FEN1_NM_004111_-1.62646
GCTAAGCGCAAGGAGCCAGAACCCAAG 1761. chr11_MTA2_NM_004739_1.57668
CAGATCTTTGACGATAGTTGCCAGGGGCAGCCGCACCAGAGGGTGAATCT
TCAATGGAGTCTTGGCGGCCTTAGGAAGTCGAAT 1762. chr11_MTA2_NM_004739_1.60269

Figure 3-143

TGCTGAATATACCGGTCTGTGGTTTTCCA 1763. chr11_MTA2_NM_004739_-1.5577
GTGGGTGGCTGGTAATGATTCAAATTGCCGAGAAAGAAAAAGTTCCCGGT
GCTTCAGTTGATGGCGCTGCTGCTCAGACACCCCTGGCTGCTTTGA 1764. chr11_UBXN1_NM_015853_-1.64058
GGCTGCTAACTCCTCGGCCTTTTCCCTCCGCCTCTCCTCAGCAGCCCGGC
GCATCTCATCTTCCTGTAGCCGCTGTCGTGCTGCTGACAACTCTTGCCCT
TGTCTCCTGCGCTGCCGTTCCCGTTCCAATGC 1765. chr11_NXF1_NM_006362_1.74827
GTGAAGGGCACACTGCACTTGCTCTGAATCATGCTCAG 1766. chr11_NXF1_NM_006362_-1.73435
GCTGTACGACTTCCCCTCGTCCGCCAT 1767. chr11_SLC3A2_NM_001012661_1.64419
AGCTGAATGAGTTAGAGCCCGAGAAGCAGCCGATGAACGCGGCGTCTGGG
GCGGCCATGTCCCTGGCGGGAGCCGAGAAGAATGGTCTGGTGAAGATCAA
GGTGGCGGAAGACGAGGCGG 1768. chr11_HRASLS5_NM_054108_1.56479
ATCTGAGGCCATTGACAAAGTGCTCACAGTTCCCTTCAATCAGGCTGTAC
TGCACGATCTTGTTGACCATCTTTTTTGTACGCTGGATGATCTTGTCCAC
CGGCAAGGGCAGGTACGTCCCATCTAGCTTGTTATTGACCTTCCAGGAGC
AGCCATGCAGCACATCCTCCAGACGACTGTATTTCACCACGGCCCGATTG
CTAAAGATGGAAGTAATGCTGCCCACCTCA 1769. chr11_RCOR2_NM_173587_-1.68323
AGAGGTCGCCACTGAGGTTAGGAGAGGCAGGAGGTCAGCGTGGCTAGGGT
CCGGCGGGGTGGGAGCCCACCTGGTAGCCCCAGCGCTCTCCACGACCCCC
ACGAGCCAGGGCGTCAGAAAAGTTTGTGCAGAAGTGGGGGACGCAAGGGA
TGAGCGCAAGGTCCGGTGCGGCTGGGGCGTGATTACTATGTACGCCCCTC
AGGGT 1770. chr11_STIP1_NM_006819_2.594
AAGCCAAGCGAACCTATGAGGAGG 1771. chr11_TRPT1_NM_001033678_-1.65074
GCCCCGCACCCCAGATCGCTGGTGCGCCCCGCAGGGTGGTCCGGGAGGCA
GGGCCGACGTGCCGACGGACCGGGCGGAAGCG 1772. chr11_PLCB3_NM_000932_1.54289
ATACCACTACGTCTGCCTGCGGAACGAGGCCAACCAACCGCTGTGCCTGC
CGGCCCTGCTCATCTACACCGAAGCCTCGGACTACATTCCTGACGACCAC
CAG 1773. chr11_PRDX5_NM_012094_-1.75249
GGGTGTGCTGTTTGGAGTTCCTGGGGCCTTCACCCCTGGATGTTCC 1774. chr11_RPS6KA4_NM_003942_-1.69529
CATGATGCTGTCGGGGCAGGTCCCCTTCCAGG 1775. chr11_SLC22A11_NM_018484_1.52652

Figure 3-144

GGCTGCCAGAATCCGCCCGGTGGCTGATTATTAAGGGCAAACCAGACCAA
GCACTTCAGGAGCTCAGAAAGGTGGCCAGGATAAATGGCCAC 1776. chr11_NRXN2_NM_015080_-2.05511
GCACGAAGGGGGATCGGGTGGCCACG 1777. chr11_NAALADL1_NM_005468_-1.5159
CAGCCCCACGGATGATGCCCAGGACGTTGGAAGAGTTCCTCAGCTCCAGG
CGGTTGTAGACGCTCACATTCACCTGG 1778. chr11_TM7SF2_NM_003273_-1.59242
GCTCCTGGCGGCCCGTTCGGGCCCCGCGCGCCTGCTGGGTCCACCCGCGT
CCCTGCCGGGGCTGGAGGTGCTGTGGAGCCCACGGGCGCTGCTGCTGTGG
CTCGCCTGGCTCGGCCTGCAGGCGGCGCTCTACCTACTGCCGGCGCGCAA
G 1779. chr11_SCYL1_NM_020680_-1.65668
AGATGGGACGACGAAGACTGGGGCAGCC 1780. chr11_LTBP3_NM_001130144_-1.8942
GGCACTGGCGCTGCGCGGGACTGTACTCGGCAGGGGGCGTGCAGGCACAG
CGGTAGCCGCCGCGCGTGTTCTCACACACTCCGTTCCGGCAGTTGGACTC
GTCCAGGCACTCGTCC 1781. chr11_SIPA1_NM_153253_-1.57879
ATCAGAACTTCTTCGGGATGGACGAGTCGCTGGGCCCGGTGGCAGTGAGC
CTGCGGCGGGAGGAGAAGGAGGGCAGCGGAGGGGGCACCCTGCACAGCTA
CCGCGTCATCGTGCGGACCACGCAG 1782. chr11_KAT5_NM_182710_-1.61033
GAGATAATCGAGGGCTGCCGCCTACCCGTGCTGCGGCGGAACCAGGACAA
CGAAGATGAGTG 1783. chr11_SNX32_NM_152760_-1.58123
GGCACTGGCCGACTACGAGAATGCCAACAAGGCGCTGGACAAGGCGCGCA
CCAGGAACCGGGAGGTGCGGCCCGCCGAGAGCCACCAGCAGCTGTGCTGC
CAACGCTTCGAGCGCCTCTCCGACTCCGCCAAGC 1784. chr11_EFEMP2_NM_016938_1.68486
CACAGGAGCGGTTGTTAGGCCCCAGCTGGAAGCCCGGCTCGCACTGGCAG
CGGAAGGAGCCAGGCAGGTTCACGCAGCGGTGCTGGCAGTAGCGGTAGCG
GCACTCGTCTATGT 1785. chr11_CTSW_NM_001335_-1.72625
AATTGCGCAGTACCTGGCCACTTATGGCCCCATCACCGTGACCATCAACA
TG 1786. chr11_CCDC85B_NM_006848_2.2583
GGCTGGAGCGGAGGGACTTGCTGGGGGTTGGATTGG 1787. chr11_---_---_1.70841
GCTGGCTTTCTAGAGTGTGTGGGGGAGAGCGTGGGGAGCAGCAGTGACTG
TTAATGCAGGAACGGTAATTTCTGATGGTGGT 1788. chr11_---_---_-1.72477

Figure 3-145

GATGGAGACCATCCAGGCTAGTACGGTGAAACCCCA 1789. chr11_BANF1_NM_003860_-1.54652
AGTCTGATCCCTCCGAAAACCGTACTTCCGGCGCTGTCTCGGAGGCCTCC
CGTCCCCTCCCTTGTCCGTCTTCTAACTCTTCCCCACGCCAGGTCCGTCA
AGCCTAAGTCCTTGAGTTCCGGGTCCGGGCAGCAGAGAAAGGAAGTCCTC
TCCCTGGAGGCCTATCTCCCTCAGAACTGCGCGAGAAGCGAGACCTTAGA
AGGCAGGGCTTCCCGCGAAGGACCGGAAAGGAGCGCCTACTAAGGACGCC
GTCGAGGTCCGGGGCGCCTCAACTCTATAGCTCTA 1790. chr11_CATSPER1_NM_053054_1.80643
TGAGGATGGCTGCGATGGACGGCAAGGACTGGCCCAGGG 1791. chr11_CATSPER1_NM_053054_-1.54697
CAGAAGTCAAAGAAGTACGAGAGGCCCAGGGCGATGATCTTGAGCA 1792. chr11_RAB1B_NM_030981_1.56338
CTTTCCCCAAGGTAGCACATCTGGCTCACTCCCCA 1793. chr11_TMEM151A_NM_153266_-1.80213
CGAGGACGGCGCTGGCGACGGCGGGGAGGTGCCCGCGCTCATCCCGGACG
GCGAGCCGC 1794. chr11_B3GNT1_NM_006876_1.65306
TACTGCCGAAAGCGCTCGTCGAAGGTGGGCACCTTGCCTCCTGCCACGTA
GAATGGCTCCCAGGGGTCCTGCCAAGGTACCACGTAGGCGGGCCGCAGCA
AGCTCTCTTCCGGCAGGTTGACCCAGCGGGAATAGTTG 1795. chr11_SLC29A2_NM_001532_-1.52964
CACCATGGCTGTGATGGCGGGGAAGACGGACAGG 1796. chr11_ADRBK1_NM_001619_-1.61279
ACTACGCTCCCTGCTGGAGGGGTTGCTGCAGAGGGATGTCAACCGGAGAT
TGGGCTGCCT 1797. chr11_SSH3_NM_017857_-1.51321
TGGAGCAGGCGATCCGTGCTGAGCTGTGG 1798. chr11_SSH3_NM_017857_1.79602
TGAAGTCCCGCCAGTCAGTGGTTACCCTCCAGGGCAGTGCCGTGGTGGCC
AACCGGACCCAG 1799. chr11_CARNS1_NM_001166222_2.00888
CTCGTGGAGTCAGACCCCAACCACTTTGC 1800. chr11_GPR152_NM_206997_-1.85264
CTGTGGCTCAGTGGGCGTGAAGCTGCCCGGCCGCTCCTCGCAGAGAGCTG
CCGCGAAGGACGAGAGCACGGAGCGCAGCAGGGTCCGGAGGTCGGCACTG
GCCATGAGGCA 1801. chr11_PITPNM1_NM_004910_-1.56943
ACTTCTGGTAGCGGGGCACGGTCAGTGGGGCGATGGCCTGGAACTTCGGG
GCCAGCAGGGGCTCGAGGCGTGAGGCGCAGGGGTCAGCCGCGTGGAAGAG
GTTGTAGATCTGTTCACAGG

Figure 3-146

1802. chr11_NUDT8_NM_181843_-1.74187
GGATCCAGTGGGCCTACACCAGCAAGCACT 1803. chr11_TBX10_NM_005995_-1.87699
AGGACACAATCTGGCGCATCCACTGGGCACCCTTGGCTGGCGAGTCGGG 1804. chr11_LRP5_NM_002335_1.95497
CCTGCAGCACCGACGTGTGTGACAGCGACTACAGCGCCAGCCGCTGGAAG
GCCAGCAAGTACTACCTGGATTTGAACTCGGACTCAGACCCCTATCCACC
CCCACCCACGCCCCACAGCCAGTACCTGTCGGCGGAGGACAGCTGCCCGC
CCTCGCCCGCCACCGAGAGGAGCTACTTCCATC 1805. chr11_MTL5_NM_004923_1.74018
GAACGCGTGCAGGACGGGTTCCTTGGGGTCCGCCGGGCCCAGGTACGCTT
CTTTGAAGACGTGGAACTCGTCCTCCTCGTACTTCACGGGGGCCTTCAGG
CCGATGTTCTCCGAA 1806. chr11_CPT1A_NM_001031847_-2.2427
AACTTGGTCCTTGACTTATAATCC 1807. chr11_CPT1A_NM_001876_-1.51495
AGTCCCATCACTCACTGGTGCAGGAGCGCACGGTCTCCGTCCTCCCCTCT
CGGAAGAGCCGGGTCATGGAGGCCTCGTATGTGAGGCAA 1808. chr11_MRPL21_NM_181515_-3.26011
CAATGCTGTTTATCCGGAGGACAG 1809. chr11_TPCN2_NM_139075_-1.50658
TCCAGACCTCGCTGTTTCGGAGGCGGCTG 1810. chr11_FGF19_NM_005117_1.73765
GGTCGTGGCCCTAGATCCTGGACGCAGCGCTCCTGCTCTGACGGCGCGGC
GGCTCCGGGCCGGCAGCCTTATATAGTAGCGCCTTACGGGCCCCACGGGT
AGGTGCCCAAGACACCCGAGCATTTCTTATCGGGATTGCATCAAGCCTCC
GC 1811. chr11_FGF3_NM_005247_1.65956
GCAGCCCACTCTGTAGCTGCCGCAC 1812. chr11_ANO1_NM_018043_-1.54078
GGCCAGCCGGGCATCCTGACCGATGGGCACCCTCTCCCAGG 1813. chr11_CTTN_NM_005231_1.89937
TTTCGGCGGCAAATACGGTATCGACAAGGACAAAGTGGATAAGAGCGCCG
TTGGCTTTGAGTATCAAGGCAAAACGGAGAAGCACGAGTCC 1814. chr11_INPPL1_NM_001567_-1.89343
CCCACCGGATGACCGGGATGCCTCAG 1815. chr11_STARD10_NM_006645_-1.51178
GGTCCTAGTCCGGCTCTCCTGGGTCCTCCGCGGAGGCTCCGACAACGTCG
ACGCGGCTGCAGATGCTGACGC 1816. chr11_ARHGEF17_NM_014786_1.55795
GATCCAGCGCATGGGTGCCCAACAAGATGATGGAAGCGATGCCCCCCCTG

Figure 3-147

GAAGCCCTGACTGGGCAGGGGATGTGACCCGAGGGCAGCGGTCCCAGGAG
GAGCTCTCAGGCCCTGAGTCCAGTCTGACAGATGAAGGCATTGGGGCAGA
CCCTGAGCCTCCTGTTGCAGCATTTTGCGGCCTGGGTACCACAGGGATGT
GGCGACCTCTTTCCTCATCCTCGGCCCAGACGAACCACCATGGCCCTGGG
ACTGAGGACAGTCTGGGCGGGTGGGCCCTGGTGTCGCCTGAGACCCCTCC
CACACCAGGTGCCCTCCGCCGACGACGCAAAGTCCCACCTTCAGGTTCTG
GTGGGAGCGAATTGAGCAATGGGGAGGCAGGGGAGGCCTACAGGTCCCTG
AGTGACCCAATTCCTCAGCGCCACCGGGCTGCCACCTCTGAAGAGCCTAC
TGGGTTCTCTGTGGACAGCAACCTCCTGGGCTCACTGAGCCCCAAGACAG
GGCTCCCTGCCACCTCAGCCATGGATGAGGGCTTGACCAGTGGTCACAGT
GACTGGTCTGTGGGCAGTGAAGAGAGCAAGGGATATCAGGAGGTTATTCA
GAGCATAGTTCAGGGGCCTGGCACCCTGGGGCGTGTGGTGGACGACAGGA
TTGCTGGCAAAGCCCCCAAGAAGAAATCCCTGAGTGACCCCAGCCGCCGT
GGGGAGCTGGCTGGGCCTGGATTCGAGGGCCCTGGAGGGGAGCCCATCCG
AGAAGTTGAGCCCATGCTGCCTCCATCCAGCAGCGAGCCCATCCTTGTAG
AGCAGCGGGCAGAGCCAGAAGAACCTGGTGCCACCAGGAGCCGGGCACAG
TCTGAAAGGGCCCTACCTGAGGCTCTGCCTCCCCCTGCCACTGCCCACCG
AAACTTTCACCTTGACCCCAAGCTGGCTGACATTCTGTCCCCGAGGCTAA
TCCGCCGAGGCTCCAAGAAGCGCCCAGCTCGGAGTAGTCACCAGGAGCTT
CGGAGAGACGAGGGCAGTCAGGACCAGACTGGCAGCCTGTCTCGGGCCCG
GCCCTCCTCCAGACACGTTCGCCATGCCAGTGTGCCCGCCACATTTATGC
CTATTGTGGTGCCTGAGCCACCAACTTCTCTTCCTCCCCCTGTGGCTGTG
CCAGAACCCATAGGCTTCCCTACCCGAGCCCATCCCACGTTGCAGGCACC
ATCGCTCGAGGACGTCACCAAGCAGTACATG 1817. chr11_RELT_NM_032871_-1.85591
AGGGCACATTATGCAGGCCCTGCCCCCCAGGCACCTTCTCAGCTGCATGG
GGCTCCAGCCCATGCCAGCCCCATGCCCGTTGCAGCCTTTGGAGGAG 1818. chr11_OR2AT4_NM_001005285_-1.84918
GGATGCCCAATAGATAGAAGACGGGTGAGCCATCCACTGATTCATTACAG
GCTGTGGCATCC 1819. chr11_SLCO2B1_NM_007256_1.50553
TCAGCCTGCCGCTCTTCTTTATCGGCTGCTCCAGCCACCAGATTGCGGGC
ATCACACACCAGA 1820. chr11_ARRB1_NM_004041_-1.67029
GTGCATTAGGGTGAAGGGCAGTTCCACGGCCACGTCG 1821. chr11_SERPINH1_NM_001235_1.78101
CTGGCACTGCGGAGAAGTTGAGCCCCAAGGCGGCCACGCTTGCCGAGCGC
AGCGC 1822. chr11_WNT11_NM_004626_-1.61071
TCGGAAAACTTGGCCCCCATGAGGAGCCCGTAGCTGAGGTTGTCCGCACA
TCCTCCCCAGCGGTTCCCGGGCCCGGGTGGCTCACCTGGGACGGGGCCGC
AGGAGCAGCCGGGCAGGTCGCCGGAGGTGCAGGCCCGGGCGATGGCGTGG
CTGATGGCGGCGGCCGACAGCGCATACACGAAGGCCGACT 1823. chr11_B3GNT6_NM_138706_-2.07469
GACCGGGGACACCGGGTCTCCTGA 1824. chr11_CAPN5_NM_004055_-1.59533
CGGCCTGGTAAAGGGCCACGCATACGCCGTCACTGATGTGCGCAAGGTGC

Figure 3-148

GCCTGGGCCACGGCCTACTGGCCTTCTTCAAGTCAGAGAAGTTGGACATG
ATCCGCC 1825. chr11_CCDC81_AK027167_1.50471
CTCTGGACTTATAAGCGCTTAACATAAACAACAACAAGAAAAGTATCGTG
GTAGCCTTGCCTATGAGCCTGCAGTTTTTAATTTGTCTGAGTCCTGGACC
TCAGCCTAGATGTAACCTTG 1826. chr11_NOX4_BC051371_1.52899
AAGCAACTTGAGGGGCGAGGTGAGGTCTTACTCTCTGGGT 1827. chr11_C11orf70_BC054869_-1.51475
GACTTGGGTGGCTACTACTTCAGGTTCTTGCCTCAGAAAACCTTCCAGTC
TCTGAGCTCTAAGGAGATCACCAGCCGGCTCCGC 1828. chr11_YAP1_NM_001130145_-1.61108
GCGGGGACTCGGAGACCGACCTGGAGGCGCTCTTCAACGCCGTCATGAAC
CCCAAGACGGCCAACGTGCCCCAGACCGTGCCCATGAGGCTCCGGAAGCT
GCCCGACTCCTTCTTCAAGCCGCCGGAGCCCAAATCCCA 1829. chr11_MMP20_NM_004771_-1.9639
CCACAGCCCACCCTTCTTCATCACGTTCATTCTGCTCTGGTCTAACTTCCC
GGTGACTTGGAGGCCAAAGAACGCTTGTAGC 1830. chr11_MMP8_NM_002424_-1.51474
AGTATTTCTCCACGGAGTGTGGTGATAGCATCAAATGTCAAACTGGGGTC
ACAGGGTTTGGGTGTGCTTGGTCCAGTAGGTTGGATAGGGTTGCTT 1831. chr11_CUL5_NM_003478_1.52211
CTTTAGTAGCTTTCCCAAAACTCAAACGGCAAGTTTTGTTGTATGAACCT
CAAGTCAACTCACCCAAAGACTTTACAGAAGGTACCCTCTTCTCAG 1832. chr11_NPAT_NM_002519_-1.5601
TTGGATCTTGGAAATTCCGTATTGTTGAATGAGGGCCAGACAAAGTGGTA
CTTT 1833. chr11_NPAT_NM_002519_-1.66235
CAATACAAGCCGGGCTACGTCCGAGG 1834. chr11_ATM_NM_000051_1.5505
CTGTTTTACTGACGTTGATAGCTGTGGTT 1835. chr11_NCAM1_NM_000615_-1.59676
TGGAGGGCATCGTCACCATCGTGGGCCTGAAGCCCGAAACAACGTACGCC
GTAAGGCTGGCGGCGCTCAATGGCAAAGGGCTGGGTGAGATCAGCGCGGC
CTCCGAGTTCA 1836. chr11_DRD2_NM_000795_-1.69656
GGGACGGGTCGGGGAGAGTCAGCTGGTGGTGGC 1837. chr11_NNMT_NM_006169_-1.95219
GAGGAGAAGTTGAGACAGGCGGTCAAGCAGGTG 1838. chr11_CADM1_NM_014333_-1.51224
AACCACCTGATAGTCGTGGCTGGCTTGCTGGCCATAGCAGTGCAGTTGAC

Figure 3-149

TTCAATCTCCTCACCTTCCACCGCAGTGTCTTTCTGGATATCGATCATCA
GATTACGTGGTGGGA 1839. chr11_SIDT2_AK303023_1.54895
TCTCTGTGGCTGATCTGGCGTCCACACC 1840. chr11_RNF214_NM_207343_1.50862
TCTCCAGCAAATGGGGTTGAAGGAGTCCGAGTGGATCAGGATGATGATCA
AGATAGCTCTTCCCTGAAGCT 1841. chr11_BACE1_NM_012104_1.80092
TCGGGCCCTCTGGGCTCGCACTGGCCCACGTCCGTCCCTGGCGCCTGCCC
CCAAGTCTGGGTGGTGCTGGTGGCTTCTCAGGAGAGGGAGCTTGGGGGCA
TCAGGACGCCAGGGCCTGCAGGGCCCTGGGCCAGCCCCCGGGTCCGGGCT
GTGGAGAGCGGTCAGGGGAGATCCGCAGAGCACGGGAGCAGGGGAGAGGC
TGGGATCCGGAGCCCGCTACATCGG 1842. chr11_CEP164_NM_014956_2.25342
CCAGCAACCACTGGGAATAGAAGACAAGGATGACAGCCAGTCCAGCCAAG
ATGAGCTGCAGAGCAAGCAGTCCAAAGGCCTGGAGG 1843. chr11_DSCAML1_NM_020693_-1.72384
GTTCTTGTATTCAATGTCGAAGCCCGTGATGATGCTGTTCCCGTCGAATC
GCTGGGTCCAGCGCAGGTTCATGCTCCGGGCCTT 1844. chr11_UBE4A_NM_004788_-1.53688
TAGTCCCCTCACCATGGACCAGATCCGGCCAAACACAGAACTAAAAGAAA
AAATCCAACGGTGGCTTGCAGAGAGGAAACAACA 1845. chr11_CXCR5_NM_001716_1.57815
CTCACCGTGGCTAAGAGTGTCCTAGGAGTATCCTCATTTGGGGTAGCTAG
AGGAACCAACCCCCATTTCTAGAACATCCCTGCCAGCTCTTCTGCCGGCC
CTGGGGCTAGGCTGGAGCCCAGGGAGCGGAAAGCAGCTCAAAGGCACAGT
GAAGGCTGTCCTTACCCATCTGCACCCCCCTGGGCTGAGAGAACCTCACG
CACCTCCCATCCTAATCATCCAATGCTCAAGAAACAACTTCTACTTCTGC
CCTTGCCAACGGAGAGCGCCTGCCCCTCCCAGAACACACTCCATCAGCTT
AGGGGCTGCTGACCTCCACAGCTTCCCCTCTCTCCTCCTGCCCACCTGTC
AAACAAAGCCAGAAGCTGAGCACCAGGGGATGAGTGGAGGTTAAGGCTGA
GGAAAGGCCAGCTGGCAGCAGAGTGTGGCCTTCGGACAACTCAGTCCCTA
AAAACACAGACATTCTGCCAGGCCCCCAAGCCTGCAGTCATCTTGACCAA
GCAGGAAGCTCAGACTGGTTGAGTTCAGGTAGCTGCCCCTGGCTCTGACC
GAAACAGCGCTGGGTCCACCCCATGTCACCGGATCCTGGGTGGTCTGCAG
GCAGGGCTGACTCTAGGTGCCCTTGGAGGCCAGCCAGTGACCTGAGGAAG
CGTGAAGGCCGAGAAGCAAGAAAGAAACCCGACAGAGGGAAGAAAAGAGC
TTTCTTCCCGAACCCCAAGGAGGGAGATGGATCAATCAAACCCGGCGGTC
CCCTCCGCCAGGCGAGATGGGGTGGGGTGGAGAACTCCTAGGGTGGCTGG
GTCCAGGGGATGGGAGGTTGTGGGCATTGATGGGGAAGGAGGCTGGCTTG
TCCCCTCCTCACTCCCTTCCCATAAGCTATAGACCCGAGGAAACTCAGAG
TCGGAACGGAGAAAGGTGGACTGGAAGGGGCCCGTGGGAGTCATCTCAAC
CATCCCCTCCGTGGCATCACCTTAGGCAGGGAAGTGTAAGAAACACACTG
AGGCAGGGAAGTCCCCAGGCCCCAGGAAGCCGTGCCCTGCCCCCGTGAGG
ATGTCACTCAGATGGAACCGCAGGAAGCTGCTCCGTGCTTGTTTGCTCAC
CTGGGGTGTGGGAGGCCCGTCCGGCAGTTCTGGGTGCTCCCTACCACCTC
CCCAGCCTTTGATCAGGTGGGGAGTCAGGGACCCCTGCCCTTGTCCCACT
CAAGCCAAGCAGCCAAGCTCCTTGGGAGGCCCCACTGGGGAAATAACAGC

Figure 3-150

TGTGGCTCACGTGAGAGTGTCTTCACGGCAGGACAACGAGGAAGCCCTAA
GACGTCCCTTTTTTCTCTGAGTATCTCCTCGCAAGCTGGGTAATCGATG 1846. chr11_BCL9L_NM_182557_-1.50694
GTCCTGGTAGAAGACACCCTGTCTAGAATGGCCCTTGGTCCTGGAGGTGG
GGCGCAAAAGGCCTCAGCCAGGGAACTGCCCTGCCACCTCCCGAGGCAGG
AAAGGAAGTGAGAAAAGGAGAAGTTTTTTTACTCCTGGGGCCAAAGTAGG
GGGACAAACACCCAGTCGTATATGGCTTCAGCTCTGACCAAAGGCGGATA
GGGAGCTCTCCTGGGTAGGAGCAGGGAGCCAAGGGGGAGGCAGTGGCTGT
GCCTGGGTGGGCACAGACAGATCTGGTACATGGCCCTGAGCCCTGGGCAG
AGGGACAACCTTGCCGGTGAGTGGGCAGGCAGAGAGGAGGCGGCAGGATG
CTGTTTCCCCGATTCCATCCTCAGGGAGTGGAGACTGGAGGGGAGGTGCA
CTGACTCAGATGAACTGTTCTCCCCCTTCTTTGATAAGAAGTAGGTGGCA
GCAGCCTCTGGAAAAGTCAGGGCCCTGGAGGTTACCTGGCCCAGGGCTAC
TACAGCCACAGGCCCCAGTGGCACCATGCCACCCCTTCCATGGCTCCACT
CAAGGGGGCCACACAGCCACCGCCTCTTCCTCCTTTCCTTCATCCCAAAC
TGGGACAAAAGACTTCAAGTTCTGGCTAAGATGTAGCAGCAGCGGATGCC
CGGGCATCCAAAGTGGAAA 1847. chr11_BCL9L_NM_182557_-1.67636
ACACAGTGGGGCTACGGCCCCTGTGCGTGCCCAGGGCCCAGCCAGGTACT
CGGTACTGGAGCACGGA 1848. chr11_FOXR1_NM_181721_-1.59599
TCCAGATTATGAGCCCAACCTCTGGATGTGGGTAAATCCCAACATTGTGT
ATCCCCCTGGAAAGCTGGA 1849. chr11_SLC37A4_NM_001164277_-1.5684
TCCAGGTTGCGGAGTCCAACATCAGCAGGTTCATTGTGGATGAGCA 1850. chr11_SLC37A4_NM_001164277_1.79734
ACCACAGTTCCTGCTTGCCGCTCTCACAGTTCCCAGATCTGCTGAGTTGG
GTTTTTTCTGCTCCCTCCTCCACCCAGCCTCCCAGGCTCCCTTTATAGCC
GCCTTCTGGACAATCATTAAGCCTGGGGAG 1851. chr11_HMBS_NM_000190_1.9804
CTGCAGAGAAAGTTCCCGCATCTGGAGTTCAGGAGTATT 1852. chr11_H2AFX_NM_002105_-1.56224
CCACGGTGGCGCTGGTCTTCTTGGGCAGCAGCACGGCCTGGATGTTGGGC
AGGACGCCTCCCTGGGCGATCGTCACGCCGCCCAGCAGCTTGTTGAGCTC
CTCGTCGTTGCGGATGGCCAGCTGCAGGTGGCGGGGGATGATTCGCGTCT
TCTTGTTGTCGCGGGCCGCATTGCCCGCCAGCTCCAGGATCTCAGCGGTG
AGGTACTCCAGCACTGCCGCCAGGTACACTGGCGCGCCGGCGCCAACGCG
CTCGGCGTAGTGGCCCTTCCGCAGCAGCCGGTGTACACGGCCCACTGGGA 1853. chr11_NLRX1_NM_024618_-1.51054
CGGCAGGCACCTAGCTATGTGACCACTGGCCCTAAACCTTTTCCCTCTGT
GGCCTCCTGGCTTGCACTGCTCCCTCTAGAAAGATTCCTTCAGGTCTGGA
GGCAGAGGAATGGGCATAGCTGAGCCAGTTGCCCTCCTAGGGCATGTTTG
ACCAGGACTGAGTCTGGAATCTCCAAGTTAAAGATGGTGAATCAATGCTT
CGGGCTTGGAGATGGAACATGCCTCCTCTCCATTCAGCTAGAAGGACCAA
AGCATGTGGCATTTGGATGGCCAGAGTGCCCTGAAGCACCACTACCAACC
TTGCCTCCCCCTCCTCTCAAAGAGCCTCTGACTGTGTCACCAAGGGGCTC
ACATCTTATG

Figure 3-151

1854. chr11_USP2_NM_004205_-1.62203
TGCCTGACTCTCTCCCACCTCCGCCGGGGGCCCAGAAGGGACCTCCCCGG
GAAATCGGCGCCACCCAGCG 1855. chr11_GRIK4_NM_014619_1.56927
GCCCTACGAGTGGTACAGCCCACACCCATGTGCCCAGGGCCGGTGCAACC
TCCTGGTGAACCAGTACTCCCTGGGCAACAGCCTCTGGTTTCCGGTCGGG
GGGTTCATGCAGCAAGGCTCCACCATCGCCCCTCGCGCCTTATCCACCCG
CTGTGTCAGTGGC 1856. chr11_SORL1_NM_003105_1.7969
CCAACTTGGGCGATGTGACCGATTTGAGTTCGAATGCCACCAACCGAAGA
CGTGTATTCCCAACTGGAAGCGCTGTGACGGCCACCAAGATTGCCAGGAT
G 1857. chr11_UBASH3B_NM_032873_-1.95475
TGGCTCAGTACGGCCACCCCAGTCCG 1858. chr11_OR8G5_NM_001005198_2.19468
ATCTATGTAGTCACAGTGCTGGGG 1859. chr11_OR8D2_NM_001002918_-1.91784
CGGGTAGTATGGACTGTGGCCCACAG 1860. chr11_TBRG1_NM_032811_1.57732
TGGATTTTCTCATCCAGCCATCCACAACCTG 1861. chr11_ESAM_AY189281_1.66167
GTGTCTACTGTGCCTACAGGCTCAGCCACTCTCCCTCCCCCAGCTCGCAT
TCTCCAAATGCCCCTCACATGCACCCATTCTTCTAACCTGAA 1862. chr11_ROBO3_NM_022370_-1.55327
GTCTCTGAGCCTGTCCGTACACAGG 1863. chr11_SLC37A2_NM_198277_-1.55027
GGCCTGGTCAATGGCCCATACGCGCTCATCACCACTGCTG 1864. chr11_DDX25_NM_013264_-1.66194
CAGGTCACAATTGTTGTGAACTTTGATCTCCCTGTAAAACAAGGAGAGGA
GCCGGACTATGAGACCTACCTCCACCGCATAGGGCGGACGGG 1865. chr11__RPUSD4_NM_032795_-1.54093
ACCGTAGGGCTTATTGATGACCACAAGGTTCTTGTCCTGGTGGAGAATTC
CTCGGGTCAGTGCCTTAGCAAGCACGTTGGGGTGGACTCGCTGCAGCTGC
CGTGTGAACCGCACTATTTCTTGCACTCTCCGCTGAACAGCG 1866. chr11_SRPR_NM_003139_1.53151
TGGTGGGAGTACTGTAATCCAACACTTCTTTGTTAGCAC 1867. chr11_KIRREL3_NM_032531_-1.51396
AGACGTCAACCGTGCGGCTGAGGTTGGTGCTGCCCAGGGCGTTGGTCACC
TCACAGGAGACGGGCTCTGAGAAGTACGTGTAGTCCACTGTGGTCCTGTA
CACCTCTCCAGATG

Figure 3-152

1868. chr11_ETS1_NM_001143820_1.69523
ACTATCGTAGCTCTCTATGCTTTCA 1869. chr11_C11orf45_NM_145013_-1.60413
GCAGCAGGTTTGCACAGGGTGCCAGTTAGGGAGGAGAAGGCAGCGAGGAA
CCCCGCA 1870. chr11_C11orf45_NM_145013_-1.56761
TCTCGCACGATCCGGCCAAGAGATGGCGGGGTGGCGGGAGGGGCGCTCTG
GCGACCCCGGAAGCGAGAAGCAGGCCTCTGCAGGGCCAGGGATGAAGGTG
CAAGGGAAAGCCCTGGGACCTG 1871. chr11_NFRKB_NM_001143835_-1.87462
CCGTGCTGGGACGCACCACATAGTCAGTTCTT 1872. chr11_NFRKB_NM_001143835_-1.50259
TTGATAGCAGGAATTGCCAGCGGAGAGGGGGCCTGTGAGAGAGGTGCGAC
CCCTTCAGTACTGCTTAGCGGCTCGGCCAGGTCCTCTGCCTCTGATTTGA
TCGTTTTTATTTTCTTCTTCTTCTTTTCCTCTTTTTCCTTAACCTTTTTT
TTAAGGACAGCCAAGTCATATAAGG 1873. chr11_PRDM10_NM_020228_1.51367
ACAGGCGGCACTTGAACGTGAAGCTGTCGTAGTCTGTGGACGTGATGCGG
GGCTTGAACGTCTTGGAGCGGCTGATGCGGTCGGCTTTCTTGGCCTCCCT
CTCAGGATTATGCATCCTCTGCATGTGTTCCCGTAGTTTGTC 1874. chr11_APLP2_NM_001642_-1.94365
CGCGCGCTAGAGCGACCCGGCGAGGG 1875. chr11_APLP2_NM_001642_-1.54066
CACCTGGCCCGAGTGGAAGCTATGCTGAATGACCGCCGTCGGATGGCTCT
GGAGAACTACCTGGCTGCCTTGCAGTCTGACCCGC 1876. chr11_ST14_NM_021978_1.53329
GCTGTACAGCGGAGTCCCATTCCTGGGCCCCTACCACAAGGAGTCGGCTG
TGACGGCCTTCAG 1877. chr11_ST14_NM_021978_1.6611
ATGCCCGGGGCAGTTCACGTGCCGCACGGGGCGGTGTATCCGGAAGGAGC
TGCGCTGTGATGGCTGGGCCGACTGCACCGACCACAGCGATGAGCTCAAC
TGCA 1878. chr11_ACAD8_NM_014384_-1.55174
CTGCCGGCGTTTCGGGGCGCGCCTCGGCTGCCTGCCCGGCGGTCTCCGGG
TCCTCGTCCAGACCGGCCACCGGAGCTTGACCTCCTGCAT 1879. chr11_GLB1L3_NM_001080407_-1.61719
GTCGACCCAGGTTAGGAAGCCCGAGGTCGGGGCGTTACCCCAAGGGCCCT
CCCGCTTCCCCTCCGAGGGCAGAGAGGCGTCCGCGCCCGGACGCACTGCG
GGAACACCTGGAGCGCCGGCGGAGCTCGGCTGTCCCCGCGGGAGGGAGCC
CGACGCGCATCCTTGGGACCCGGACCCGGCGCCCGCGCCTCGGGACGGAT
TTCTGCCTCGGCTGCAGGCGCAGCGCGCAGACCTGAGCCT 1880. chr12_SLC6A13_NM_016615_-1.64899
ACAGACGCGTGAGGTTTGGGTACAGGTAAAACTGAATTCCTTGGGCTGCC

Figure 3-153

CCAGGCAACGTCACCCCTCGAATTAACAGGACCACCAGCATGAGGTAAGG
A 1881. chr12_NINJ2_NM_016533_-1.58364
ACCAGGGTGGTGTAGTAGTGAGAGGATGGTCCCTGCTCCAGCACCGCCTT
CAGCCGCATGGCGTTGGACATGAACAGGGCCACGTCCAG 1882. chr12_CACNA2D4_NM_172364_1.58858
AGATAGAGCTTCCCTCCCAGTGGACCCTGCTTAGCAAGTTGGAATGTTCC
CACAAGTTCCAACCCTAAGGATTTCACTCCAGGGACAGAGTCAAGTAGAT
TCTTTTGTAAATCATTGGCCAGAAAAGAGCACAACCACTGCTCTTTTTCA
CTATTTTACAGCTATTTTTGCCGTCCCCTGAATGTACATCAATTTCCATG
CAGCAATTGGATGTCTCAGCCTATTGGCTTTTCATAGATGCAAACTTTCC
TTTAGGGCTTTGTAAAGAAGTTTTGGGAAGTTCTTCAATAGCAGCAGTTT
GGGGACATCACGTGTAGCCCTGTCGATATTTCCTGAATGGATTTCATTCC
TTTCTCAGTCTTGACCATTCCCTTACCCAACCCCCACCCCAACACAGTCA
AAACCTTTTCGAGCAGCAGCTAGGAAGGTGAGTGGCCTCCCACCATGAGC
CTCACTTTGGGGAATCTATGCTTTAGTTGGGGCATATTCTTGCCTTAGCC
TCATCTCTGCATTTGGCCTCATTCTGCTGCTGCTTCTCAGTACCCAGAAG
TCCTTGGGTTCTACCAGAGACCACTCCGACAGAAAGGGTCAGAAACAACT
GACCCTTTCTTGGCTGGGTCTGGACTCTGGAGTACAGGAAGAACTAAATT
ATTTTGTCTTGGTCCAAGCTGAGCTCACGCTGGCTTCCCGAAGAGGAGAC
AGGAAGGTTAGGTCAGAAGTATGCTCATGTTGAGACCTAGGGCAGATGGT
ACCGGGCACCATGAAGCATCTTGA 1883. chr12_CACNA2D4_NM_172364_-1.90761
CAGCAGGAGTAGGGGCGGCGAGGCTGAGGTGTCCGAGGCGC 1884. chr12_CACNA1C_NM_199460_-1.55599
GAGGCTACGATTTGAGGAGGTTGAGGGGGAAGACAGGAGGGAAAGAAAAG
TCCTACAACTGTCAGGAATGGGGCACCTTTCCCT 1885. chr12_PLEKHG6_NM_018173_-1.82454
GGATGCGGGGGCCCCACATCATTCAGC 1886. chr12_LTBR_NM_002342_-1.659
TGCCACACCCTCTAACAGGGGCCCAAGGAACCAATTTATCACCCATGACT
G 1887. chr12_LTBR_NM_002342_1.52887
AGCAAACCTGAGGCCTCCCGGCAGACCCACCCACCCCCTGGGGCTGCTCA
GCCTCAGGCACGGACAGGGCACATGATACCAACTGCTGCCCA 1888. chr12_TAPBPL_NM_018009_-1.55007
GACACAGACCCAATCCCTGAGCTTCCTGCTGGGGTCCTCAGCCTCCTTGG
ACTGTGGCTTCTCCATGGCACCGGGCTTGGACCTCATCAGTGTGGAGTGG
CGACTGCAGCACAAGGGCAG 1889. chr12_IFFO1_NM_080730_-1.65271
CAGGTGCCGGTTCATGTCGTTCTTGGCCGTGGCC 1890. chr12_IFFO1_NM_080730_-1.58429
CGACCAGATGGTGCCGGGCATGAAGCGGGCCGACGAGGAATAGGTGGTGG
AGGTGGAGGTGGAGGACGACGAGAGGCTGGCCGCGGAGGGCGCGAGGGGG
CCGGCCGGGGAGCGCGCGGGCGAGCCCAGCACGCGCGCCGAAGGGCTGCA

Figure 3-154

GACAGCGGCCGGCCGGGCGCCCAGCTGCAGCCCCAGGGGCCGGATGGGGC
TGACGAAGCCGGTCTGCACTGCCTGGTCGCGACGA 1891. chr12_NOP2_NM_006170_-1.73489
CCTCCAGGGGCACAACACATGTCCAGGATCCGCTCATGTTCCTGGGGTGC
CAAGGCCATGACGGGCAACATGCTGGAGGCTCCCTGCAGCATGTAGTGCC
CAGCCAGGT 1892. chr12_GPR162_NM_019858_1.76452
GCTCTGCTTCCTAGCGGGCACACACATACTCATGGCAGCTGTGCCCCTCA
CCACCTTTGCCGTGGTGCAGCTGCGTCGTCAGGCTTCCTCCGACTATGAC
TGGAACGAGAGTATCTGCAAGGTCTTCGTGTCCACCTACTACACCCTGGC
GCTGGCCACCTGCTTCACGGTCGCCTCCCTCTCCTACCATCGCATGTGGA
TGGTGCGCTGGCCCGTCAACTACCGCCTCAGCAACGCCAAGAAGCAGGCA
CTGCATGCCGTCATGGGCATCTGGATGGTCAGCTTCATCCTCTCCACACT
GCCCTCCATTGGCTGGCACAACAACGGCGAGCGCTACTATGCCCGCGGCT
GCCAGTTCATAGTCTCCAAGA 1893. chr12_LPCAT3_NM_005768_1.66112
TGATCTTTCCCTCCGTCAAAGTAGTCAACAGCCAAAC 1894. chr12_FAM90A1_NM_018088_1.53738
CCGCCATGTTTTCAAGCCCGAGGCCAGCT 1895. chr12_PZP_NM_002864_-1.57643
GTGCTGCAGGGGGCGATATACTCAGCAACCACAG 1896. chr12_CLEC1B_NM_016509_-1.64893
GAATCAAAGCCATCACACGCCACCAGGAGG 1897. chr12_TAS2R10_NM_023921_1.64379
AATACTATCATGAAGGGAAGAACCATATTTGTTCTGCTCTTCAACCAGAG
AAATATGTAGTTGGAAAAATTTGCTATCTTCAGGAAATAGAAGATGCTGA
GGCTGGTGGCAAACCACATACTTGATTGATTACCAATTACCCAAAAGTAA
CTAATATATTCAATTAGGTTACCGGAGGCATATATATTTGGAGAGAATAT
CTGTATAAATCCATCTGTAATTATTATCCATATCAGAAAAATTCTTGAAA
TAGCTAAGCCGGTGAGAATAAAGCC 1898. chr12_DUSP16_NM_030640_-2.11458
AGAGTCGGCACAGGGTGGACTGAGGGGCGTCTCGCTTTTCTGTCC 1899. chr12_EMP1_NM_001423_1.52527
CCAGTACACCAGCAGAGGAAACTTATAACCTCGGGAG 1900. chr12_C12orf36_NM_182558_-1.5277
AGGAACCTAAAGAAGCTCTCCCTCT 1901. chr12_MGP_NM_000900_-1.66468
TACGGGATGTTAGTGGAAGGCTGTGAGG 1902. chr12_RERGL_NM_024730_2.32543
CCTGTTCCTTCACCACCCAAGACA 1903. chr12_PIK3C2G_NM_004570_1.53093
TAGTGGAAGTACCTCAAAGCAGCAATACGAGTCTGGCCTCTTTTT

Figure 3-155

1904. chr12_LDHB_NM_002300_1.50599
AGGTGTCTGAAGAAATAAGCTCCCA 1905. chr12_ETNK1_NM_018638_1.62731
TGGCCAATTACATCCACGTCCCTCCCGGCTCCCCGGAGGTGCCCAAGCTG
AACGTCACCGTTCAGGATCAGGAGGAGCATCGCTGCCGGGAGGGGGCCCT
GAGCCTCCTGCAACACCTGCGGCCTCACTG 1906. chr12_SOX5_NM_006940_1.57403
TTCCTGCCGCCTGTTGCGCATGATTGCCTTGTATTCACCAATGCGCAGCT
TTTTGCCATCCACCAGGCAGGTGCGCTTTGGCCTGGGCTTGTACTTATAG
TCA 1907. chr12_IFLTD1_NM_001145728_1.50526
ATGGTTAAACAATTGCACGTGCTCTTCTTTTGTGAGTTCTGTACCCAAAA
TAACTTTGTTTACAAAAAGAGAAATCTAAGGCAAATAGCAATTTTATCCA
TTGAATAATACTAACCATCTGCTTGTTTTCTGCAGGGATTTGGAAGGCAG
GAGTGGTAGGACTTGTGATTTCATCAAGCATCTATAATTCACCAATTCTA
CAGCAATACAAATTTTGGATCCTTTTTCCATATAGAAATGTGATGTCTTC
ACCCTCTCATGGAATAGCAGGGAGGTTGCAGAGCAGGCCTCAGGGATTTG
AGTTCTCTTTTGCTTTTCTAGTAGCTGGTTGAGGGTG 1908. chr12_FLJ13224_NR_026806_1.59113
CATCCCTCCGGAGTTGAGCAAACAACGCCACGCCGCGTGCGCTCCGGCAG
AGCCCAGCACTGACCCCCAAAGGCCGATTTAAAGACCCTCGGCCGCCAGC
TCGGAAGCGGATGGCAACTTAGTTTCCGAGCGAATGGCGTTTATTGTCCA
CCCTAGTCCGAGGGCTGCAGTCAACTAAACCACGAGGTTTCACAACGGCG
CCCGACCCTGCCCGCGCCTCGCGCCCACGCGGACGCACCGACCCCGGCCG
CTGCGCGGTGGCCAACGAGTCGCTTTCCTCTCGGGCCTTTCGGCCGCCGG
GCTCCTTTCCGCGAGAGAACACTGCGGCGGAGAAAAGTCATTGTCACCTT
CAACGTGGATCCCTCAACTCCGGCGACTCCTCAATTATGCCCAGGCTCCA
CTCACTTCCCCGCCCCGAGACTTTCGGTTTGCCTCAAATA 1909. chr12_CPNE8_NM_153634_1.72556
CCTCCACCCGCGTGGCCGGGATGGCAGCGCTCAGCTGGTTCAAGTCC 1910. chr12_GXYLT1_NM_173601_-1.57859
ACCGCCGCCCGTTCCTTCTTCCAGGGACACGGCGAGCTGGCTGAAAGCGT
AAAGGAGCGAGCAGAAGCCGCAGGCCACACACAGCACCACGACGCGCAGG
TAG 1911. chr12_PPHLN1_NM_201515_1.52519
AAATTTGATTCCTAAAAGGACTCA 1912. chr12_RAPGEF3_NM_001098531_-1.60087
AGGGTTGTGGCTTCGGCAGTGGTGCAGCATCCGCGCGGCTCT 1913. chr12_RAPGEF3_NM_001098531_-1.58517
GGGCCACAGCTTCGGCCAACTCCTCCTCCATCTCATGAGTTCTCACGGGC
TCGGGCTCGGGCCCGGGGAACCGGTAGAATTGGGCATCTCGGTC 1914. chr12_DDX23_NM_004818_1.5421
CTGAGTCTGAACCGCCCAACGCGGCCTCAACGTCGCGGAGCCGTCGCCAT
CTTTCCCGTTTCCTGGTCGCGGAGATGAACACCC

Figure 3-156

1915. chr12_MLL2_NM_003482_2.13744
TGGACAAGCAGGAGTTGTGAGTCCCCAGA 1916. chr12_MLL2_NM_003482_1.50959
GAAGAGCCCTCATGTGGCAAAGACATGGCCTGGGCAGGGCCTGGTGCAGA
CAGTAGGGAATGCT 1917. chr12_MLL2_NM_003482_1.53531
CTGCACCTTGTTGATGCGGTGAGCTGCCCGGTTATCTTTGGCCTT 1918. chr12_TROAP_NM_005480_-1.81444
CCAGTGGCTGCGTGGTGTCTCCCCT 1919. chr12_KCNH3_NM_012284_2.75488
AGGAAGAGCTTTGCCATCCCCTGC 1920. chr12_PRPF40B_NM_001031698_1.71961
CGGCTCCGGGTGCGGACACCGCCAGCT 1921. chr12_PRPF40B_NM_001031698_1.95591
TCCACACCAAAGGCCGAAAGCATGGCAGGA 1922. chr12_NCKAP5L_NM_001037806_-1.98698
CCTCCAGTTGTCGGGGTGGGCACATGAGAGGGTCCGAGGAGCTGCCGGCT
GCCCTAGTATTGGGGAAGGTCCAG 1923. chr12_---_---_-1.59096
TCCCTCATGCTTGAGTCCCCTGGGGCCACCTTGAGGCAGCCTATCCCAAT
GCATCCCCGCCCCGCTATCCGGGTGGGGCGCAGAAGAGAGGGGAGCCCTT
CTCCGCTCAGTCTCC 1924. chr12_METTL7A_NM_014033_-2.12772
GAGCAACCGCACCCAGCTTAAGGTTT 1925. chr12_SLC11A2_NM_001174125_1.59276
ACACAAAGCCCAGATAAGCCACGCTGACCACAGCAGCCACCACATATAAT
GCCACATGCCCTAGGTCCCGGACATAAACCACTACAAAGTACATATTGAT
GGAACAGATGATAAGGACCAAGATTCCTCCTGC 1926. chr12_LETMD1_NM_015416_-1.58678
TGTGTGGGGCTCGGCAGTCACCCCTGGACATTTTGTCACCCGGAGGCTGC
AACTTGGTCGCTCTGGCCTGGCT 1927. chr12_BIN2_NM_016293_1.68465
GGTACCATGGAGACTTGAAGCTGGTCT 1928. chr12_ANKRD33_NM_001130015_-1.58855
CAGCCGAAGCCCAGTCCTTCAGGACACCAAAGTCTGGCCCTTCCTCTCTG
GCGATACCAGGAGCTCA 1929. chr12_C12orf44_NM_021934_1.51029
GGAACGCGGGCGCTCCTCCAGCTTCCGAGTCCAGCCAGCCTGGGCGCGGG
GCGCCGCCCCCGAGACACCCGAGGAGTCCGTTCCTCCCTGGTTACGTGGA
CTGTGGAG

Figure 3-157

1930. chr12_KRT7_NM_005556_-1.65774
GCTGGACGCCGACCCCTCCCTCCAGCGGGTGCGCCAGGAGGAGAGC 1931. chr12_SPRYD3_NM_032840_-1.51863
GTCCCACAGACTCTGACATCATGTAGCCGGCCCCATTCATCCTCGTAACT
GTCCACCATCATGACGCTGTCGTCCTCACGGCCCAGCTCAGCGTTGAGGT 1932. chr12_ZNF740_NM_001004304_1.50667
CAGCAAGCAGGCCGAGAATGGCGAGCGGGCAGGTAGCCCTGATGT 1933. chr12_SP1_NM_138473_-1.74974
ATGCCCAACCCCAAGCCGGTCGGAGGACCCGGCGGGAAGCATGCACCTGC
CCCTACTGTAAAGACAGT 1934. chr12_AMHR2_NM_020547_-2.30255
GGCTGCCTTGGCCCATCCTCAAGA 1935. chr12_ATF7_BC042363_1.64464
ATAAAAATAGCCTAGGTCTGAATAC 1936. chr12_COPZ1_NM_016057_-1.65001
GTGATCCTAGAGAGTGATCCCCAGCAGGTGGTACACCGGGTGGCATTAA 1937. chr12_KIAA0748_NM_001098815_1.68972
GATCTTCCTGTGAGAATTGCCCCAAATCAGAGTCTTGCTGGAGGAACTGC
TTCTCTTCTTTCACTTTGTCCATCACTTCCAACACAACTTGGTCCAAACT
GTTCCTTTTGGGGGTGTTGTGGGGTGGTGGTGGCCGGTCTCGGGGGCATG
TGTACAGACACATCTTGGAGATGGCTTTCCGAAGGCGGTCTCTGGGTGAC
TGGGGTTCAGGCTCTCGGGACAGAATCCTGATGGATGGCACATCAGTTGG
ATGGTTGCAATTCCAGAACATGTGGGATGGTGTGAACTTTTGGACAGGTG
TCTTAGACACATAGGAGTAGAGACA 1938. chr12_ITGA7_NM_001144996_1.56206
GCTCAATGAAGACACGGGCTCGTGCAGAGACTGGAT 1939. chr12_MMP19_NM_002429_1.57993
TCGAGGCGAGTAGACAGCAGCATCCAGGTTTCCGGGGAGCCCCTCCCAAA
GGGCAGACACTCGGAACAAGGGGCCCGGTCCTGAATCTGATACAGTCCAC
ACATAGTCCCCCTTGAAAGCATAGGTCTTCCCACGGG 1940. chr12_CNPY2_NM_014255_1.64526
TAAGCGGGACTCCAGCGTGCTGCGGTGCGAGCCCCAATCAGACACCGA 1941. chr12_TIMELESS_NM_003920_1.52136
GAGGGCTCGAGTCTTCTTTTCTGCCATCTCTCGCTGGCGCAACACCTCCA
GTTCTGCAAAATCTGCACTCCGCTCCTGAGCTAAGCGTCCCTGCCCTACT
C 1942. chr12_PRIM1_NM_000946_-1.6573
CCACCGTAGTTGAGCCAGCGATAGTACTGAGAGTAGGGAAAGAGCCTCCG
GTAATAAAGTTTAAGCAGCTCGGGCAGCTCGGTGGGGTCAAACGTCTCCA 1943. chr12_PRIM1_NM_000946_1.51607
GCGGAACTCGCCACGGTAAGGATTACCACAGGAATTGGCGGGAACAGCA

Figure 3-158

1944. chr12_LRP1_NM_002332_1.63177
GGACGGACGATGGGCCCAAAAAGACAATCAGCGTGGCCAGGCTGGAGAAA
GCTGCTCAGACCCGCAAGACTTTAATCGAGGGCAAAATGACACACCCCAG
GGCTATTGTGGTGGATCCAC 1945. chr12_LRP1_NM_002332_-1.62093
GCCATGGCAGTCGCCACTCCCTGGCCAGCACGGACGAGAAGCGAGAACTC
CTGGGCCGGGGCCCTGAGGACGAGATAGGGGACCCCTT 1946. chr12_GLI1_NM_005269_-1.64525
GCAGCACCACCTCGACTTCTGCCCCCATTGCCCACTTGCTATGGGCCTCT
CAAAGTGGGAGGCACAAACCCCAGCTGT 1947. chr12_B4GALNT1_NM_001478_-1.68145
GCTCACTGACCCAAAGATTTGCACCGTGTGGGTCTGACCTCATCATGTGG
AGTGCAGAGGGCCCTGATGACATGTGTGTGATGAGGACCATGACCCTTGA
ACCC 1948. chr12_CDK4_NM_000075_-1.62522
CCACATGTCCACAGGTGTTGCATATGTGGACTGCAGAAGAACTTCGGGAG
CTCGGTACCAGAGT 1949. chr12_TSFM_NM_001172696_-1.54583
AAGGCCTGATTGGGCTGTTGCAGGAAGGAAACACAACTGTATTAGTAGAG 1950. chr12_CTDSP2_NM_005730_1.68802
GGTGGAACACGCAAGACTCACGGAATAGGCGGGCCCGGAACACCCCACAC
CGGTCCAGCAGGTCTGTCACAGGGTCGGCATA 1951. chr12_XRCC6BP1_NM_033276_-1.70423
GCCCTTCTTCCCTGCGGAGGGAGGGCCTGGGCGGTCGCGTTGGCGGGAGG
GAGGTTACCTTTCCCAGTCTCGCTCTGGCCGCCTGAGCCAGGAGGAAGCA
GCGGCGAGGTCTGCGGGAG 1952. chr12_MON2_NM_015026_2.00601
GGGCGACTCGGCTAATGGCGTCGGCGAGTCTTAG 1953. chr12_C12orf66_NM_152440_1.56331
CATGATGGCATCCAAAAGGCCAACGAGCTCTTCAGCATTGATGAACTTCT
GTGTGCTGAGGGTGTACATCTTCTCATAGAAGTCTGCCATCTCCATCCGA
GCCTGAACAAAGAAGCAGAGCTGCTCTGACAGGTGGGAAAGGAGTTCTTC
CACGTGAGGAGCAGTCCCACCCAGGGCACCACGGCCAGTCACCACCTTCT
TCAGCTCATTATGCAATGAAGTATAGATGGTGCGGATGGAATCCTTCC 1954. chr12_GNS_NM_002076_1.61041
AGCTGAAGGGCGAGAGGCCGACCAGCCGAAGGAATAAAAAGCCGTGCCTT
GAAGGCCGGTGGCTGGAGTCAGACGTTTTCTCCCTAGGCGCGATCACGT 1955. chr12_RPSAP52_NR_026825_-1.68076
TGAGCCTTCCAGTCTTCAGTAGAAAC 1956. chr12_PTPRB_NM_001109754_1.51743
CGTATGTGGTGTTGTCTATCCGAAAGGTAGGGCACAACGCGGCCCCCAGG
GTGTCACTGCTATAGATGAGGCTAAAGTTACAGGGTGAGCCCAAAATTCT

Figure 3-159

CCACTGGATAGACACAGAATGGCTGGAGGCCTTGGACTCCGCCAGGGTGA
AGTTACATCTCT 1957. chr12_ZDHHC17_NM_015336_-1.60326
CCTTTTTCGATCATTCAATGCATAGTGCATTGCCCCTTGGGATATATTTG
G 1958. chr12_C12orf50_BC038413_1.84154
GATGACAAAATATCTGGAGGAGTA 1959. chr12_CEP290_NM_025114_-1.50564
ATAGCCTCTTTCCGAGATTCCCTGAGCTCCTGTCTTAATTCTTCATTTCT
TCCGGTAAGCTGATCAACTTGGGCTTTCAA 1960. chr12_C12orf37_AK058107_1.52047
TCCCATGAGCATGAGAGAAGAAGCAATGCACGCTCCGGCAGATTCCT 1961. chr12_PLXNC1_NM_005761_-1.63953
GCCTGCACTTCGTGGACGCCTTTCTCTGGAACGGCAGCATCTACTTCCCC
TACTACCCCTACAACTACACGAGCGGCGCTGCCACCGGCTGGCCCAGCAT
GGCGCGCATCGCGCAGAGCACCGAGGTGCTGTTCCAGGGCCAGGCATCCC
TCGACTGCCGCCACGGCCACCCCGACGGCCGCCGCCTGCTCCTCTCCTCC
AGCCTAGTGGAGGCCCTGGACGTCTGGGCGGGAGTGTTCAGCGCGGCCGC
TGGAGAGGGCCAGGAGCGGCGCTCCCCCACCACCACGGCGCTCTGCCTCT
TCAGAATGAGTGAGATCCA 1962. chr12_NEDD1_NM_001135175_1.59867
GTGTGCTGCCTCCGAAAAGTTTGCCTCGTCTCCACAAGTCTGTCTCCTTT
TTTGTCAACCTCAAGTA 1963. chr12_SLC25A3_NM_005888_1.61399
TCTGGCGCACATCACTATATTTGGCTGCCTCTGCCAGTGCTGAATTCTTT
GCTGACATTGCCCTGGCTCCTATGGAAGCTGCTAAGGTTCGAATTCAAAC
CCAGCCAGGTTATGCCAACACTTTG 1964. chr12_APAF1_NM_013229_-1.56737
CTATGACTGGGGAACTAGTACACACCTATGATGAGCACTCAGAGCAAGTC
AATTGCTGCCATTTCACCAACAGTAGTCATCATCTTCTCTTAGCCACTGG
GTCAAGTGACTGCTTC 1965. chr12_SCYL2_NM_017988_-1.61359
GCCAAAGGTTCTACCAAAACTGCC 1966. chr12_ANO4_NM_178826_1.67299
TTTACAGGACACCCAGGTGCCTACTTGA 1967. chr12_CCDC53_NM_016053_1.83338
CGGTGGACCCCGAGTTCACCCACAAACCCCTCCCAGATGGGGCCCGCCCA
ACCCGGTAATCACGTCTCAACTT 1968. chr12_C12orf42_NM_198521_-2.17071
CTGCAGGGTCCCTATCCCGGGGCGCC 1969. chr12_HCFC2_NM_013320_1.60072
CAATAAGAAAGCACCTTTAAATTGA

Figure 3-160

1970. chr12_NUAK1_NM_014840_1.66381
CTCGGCCAGAAAACCTCTCGGTGGCCCGCTTGACTTTGCCGTAGGTGCCT
TTGCCCAGGGTCTCCTGCAGCTCGTAGCGGTGCTTCAAGTTGTGCTTGTG
GTGATGCCGCTTCACCCCGTGCG 1971. chr12_POLR3B_NM_018082_-1.57448
ATATTGAATATACCCGAGGCAGCCAGAGGATCATCCGCAATGCCTTACCT
ATCGGCAG 1972. chr12_POLR3B_NM_018082_-1.58164
TGTTTGTGGCTTGATCGTCCCCCAGGAAGAC 1973. chr12_SART3_BC041638_-1.57266
CACAGGGTCGTGGCGAGGATTCAATGAGATAACGTTTGCAAGGCAATGGG
CAGGCAGTAAGCACTCAAATCCGACAGGAGCTACTGTCACGAAAAGCGGG
TTTGCAGCCTTGGC 1974. chr12_TCHP_NM_032300_1.72673
GATGCAAGCCTTCCGGCAGAAGGCA 1975. chr12_GIT2_NM_057169_2.23206
GCTGCTCCGGAGCCGTTTCGACAT 1976. chr12_C12orf24_NM_013300_1.73277
CCCGCACACGGCTCGCGGTCTCGGCGCCGCGGAGATGCCCGGCCAGG 1977. chr12_RPL6_NM_001024662_1.63788
CCTGTGGCGTCCAGTGAGGATGATCAGAATGGTCCCGGGGGTAATGCTGG
CTCGCAGTTTTCTCACGTGCTGACTGAAGGGTTTTTTGCCGTGGCTCAAC
AGCTTTCGAGGCACATCTTCAGTAGGATAA 1977. chr12_DTX1_NM_004416_-1.73007
CATCCTGGCCTCGCAGCGCCGCAAGGCGCCCCCCGCGCCCCCGCTGCCGC
CGCCGCCGCCACCTGGAGGGCCTCCAGGCGCGCTTGCCGTGCGCCCCAGC
GCCACCTTCACAGGCGCCGCGCTCT 1979. chr12_DTX1_NM_004416_-1.66559
TGACCGGGATACTGCTGTGCGCGGCCGGGCTGCCCGTGTGCCTGACGCGG
GCCCCCAAGCCCATCCTGCACCCGCCGCCCGTGAGCAAGAGCGACGTGAA
GCCCGTGCCTGGCGTGCCCGGGGTGTGCCGCAAGACCAAGAAGAA 1980. chr12_TBX3_NM_005996_-1.52529
CGATGTCCCTACAGTGGAGGCGGCTGGAGAAGAAGCCTGGGCGAAGCAGT
TGAAAGCTGCTTGTTCACTGGAGGACTCATCAGAGGTCCCATT 1981. chr12_C12orf49_AK298857_-1.89207
TGAGGAAGTAGACGAGCGACAGCCCGAAGACCAGGGCGAGCAC 1982. chr12_FBXW8_NM_153348_1.63834
CACAGCCTCATCACGGCCAACGTGCCTTACCAGACGGTAATGCGAAACGC
CGACCTGGACAGCTTCACTACTCACAGGAG 1983. chr12_NOS1_NM_000620_-1.72363
TCGTACGTTCGCAGGGTGACTCCAAAAATATC

Figure 3-161

1984. chr12_TAOK3_NM_016281_-1.66063
CAATGAGGACACGTAGTGGCCGGTCTCGTCGAACAAAGTCAT 1985. chr12_PRKAB1_NM_006253_-1.5717
AAAGCGCGATTGCGAGAGCTCGGCAACCCTGCCGACTCAGCCGGAACCGG
CTCCCGGCCCGAGGGGCGTGGTGTCCTGGTGCTCCGACTCCTTCCGCAGG
CTCCTTGGGACCCGCGGTTCCGGGAGTCCCTTGCTCAGGGTCCCTTTC 1986. chr12_CIT_NM_007174_-1.72679
CTCCTTTCTGCGGCTGGATGGCGGGGCCAGCAGGCTCATGGCACTGGGCT
GGTGCTCTGGCGACCGCACGATGGCGGACATGGCGATCTGCTGCCTCGCG
GTGGCTGGCGTGGATGGGTGTGGGTGGTCCGTTGCTTTGCGGTGGGCAG 1987. chr12_PXN_BC052611_-1.54772
ATACCTCCGAAGCCCATGGCTGCTCCCATGTGGCAGCCAAGGCCTCCTCT
GGGCACGAAGGGCTGGCTGGTGGCCCCTGGGGCTCCCCAGGCTCTTGGAG
AGCTGTGCTCCCAGCACAGGGTACAGTGTGGCAGCGGGGAGCCCCAGAGA
GCTCACTTGTGATGGTCGGCAGGTGCCTCCAATCTCG 1988. chr12_PLA2G1B_NM_000928_1.59088
GCTACAGGTGATTGCCGAGCCAGAGCACGAGTATGAATAGGTGTGCCTCT
ACGGGTTGTCCAGCAGAAATTTACAGCTGTCCAGCTTCTTGGCCTGGTCA
TAGCAGTTGTCATGTG 1989. chr12_MSI1_NM_002442_-1.70004
GCCTGAGAGAGCGGGCCTGCCGTGGCCAC 1990. chr12_GATC_NM_176818_1.64441
TCACGGCTGCGGTGATCGAGCACCTGGAGCGTCTAGCGCTTGTGGACTTC
GGCAGCCGCGAGGCAGTGGCGCGACTGGAGAAAGCTATCGCCTTCGCCGA
CCGG 1991. chr12_---_---_1.56638
CACACCATGGCACTTGACCCATAGCAACTGTTGAAAAACCACAATGGCAC
GGTTACTAAATAAGCGAGGCATAGCCTTCTCCGGCTTAG 1992. chr12_CAMKK2_NM_006549_-1.68311
GGTCTGGAAATTCCAGGGCCTGACTCTTGATCTTACTGTGTAAACACATG
ATCCGCTCGTCCATGAATGGGCA 1993. chr12_---_---_1.78479
AATTATGGTACATGAAAATAATCT 1994. chr12_---_---_-1.50279
AGCTATTTGGGAGTCTGATGCATAAGAATAGCTTTAACCCAGGAGGCAGA
GGTAGCAGGGACCCGAGATCAT 1995. chr12_KDM2B_NM_032590_1.69001
GAGATCCCGCATCTGGGCATCCTTTAGTCCCTCCACCCACTGGACATCCA
GGGTCCGGAGCAGCGGACAACTGGAGCTGCAAAGGGCCGAGACCGCGATC
CAT 1996. chr12_KDM2B_NM_032590_-1.8136
CTGTGCATGACGTGGGCTGCCCCATCGTCCAGGGGTAGCGAGTCAGGCGG

Figure 3-162

GGGGCTGATGGGGGGTGGCCGGATCACATGGCGCTCCATCTGGATACACT
TGGGCGGG 1997. chr12_CLIP1_NM_002956_1.73563
CTGAACAGAGACTGCCTCCTCTGA 1998. chr12_KNTC1_NM_014708_-1.82785
AAGCCATCTCCAGTATCCATTCTT 1999. chr12_HIP1R_NM_003959_-1.68986
CCTCATAGACACCTGCAGGGAGTGCGGGGCCCGGGCTCTGGAGCTCATGG
GGCAGCTGCAGGACCAGCAGGCTCTGCGGCACATGCAGGCCAGCCTGGTG
CGGACACCCCTGCAGGGCATCCTTCAG 2000. chr12_ZNF664_NM_152437_1.69962
GCGCCCTGCGTCCGGCAGAGGAGGCGAG 2001. chr12_FAM101A_NM_181709_-1.72831
GGGCGTCCCCAGCTAACACCCATCCACGCA 2002. chr12_NCOR2_NM_006312_-1.67328
CATCCCGGTACAGCAGCGGGTACACAGCACTCCGGGAGTGCCCTGGCTCC
GTCATGCCCTCCGGTGGGGACACAGGTTCAATACCGTCCTCACCACCACC
CAAGACCGACGTCTTGTTTGGCTCTG 2003. chr12_NCOR2_NM_006312_-2.308
AGCTCACAGGGCTGACGGGCTCCACCCCTTCG 2004. chr12_NCOR2_NM_006312_1.50283
TTCTGTCCAGCGAGAACTCTCATTCAGCTCCATG 2005. chr12_NCOR2_NM_006312_-1.68826
ATTCCCGGGCTGGAACTCAGACAGCAGGGAGGGCCTCCGCCGCTGGGGCT
GGATGATGGAGCCGGGCGACAGGTGGGAGGCATAGTCGCGGGAGTGGTGC
TGGTACTCCAGGAGCCCGACGTC 2006. chr12_GPR133_NM_198827_-2.08522
ACCCGGCCAGGCATGGCCTCCACCAAGCTCAGCCCTTGGGACAAGAGCAG
CCACTCTGCCCACCGCGTCGACCTGTCAGCCGTGTGA 2007. chr12_SFRS8_NM_004592_1.52198
CCGCGGCCCACTCGGCGCACTCAGCCAGCGTCTCCCCTGTGGAGAGTCGG
GGCTCCAGCCAG 2008. chr12_ULK1_NM_003565_-1.88141
CATCACCCTTTCCTCGATGCCAGCCCCTCGGTCAGGA 2009. chr12_EP400_NM_015409_1.52185
AGAACGACACATTGGATACAGAAG 2010. chr12_POLE_NM_006231_-1.70128
GCACGGACGCAGAGGCACCCGGGGCC 2011. chr12_POLE_NM_006231_-1.50482
ACCAGCTGTTTATTGACCACACAC

Figure 3-163

2012. chr12_POLE_NM_006231_1.69921
GCACAATCTGCCACGGAAGGTCCAGGATGCTGCGGGCAGTTCTTCGCAAG
AAGCTCCCCAGCCCCGTGGCAGGACCATCCCGGATGGCCCCGGGCCTGAG
CACACCCTCTGCCGACTCCAGACGCTGCCTCTTCCTGCGGGCGAGGCGCT
GCCGGGCCTGCAGCTGCCACTTCTTCTTGTGGAACCGGAGCCAGACA 2013. chr13_ITGBL1_NM_004791_2.28431
GCAATTGCAACTCCGGCTGGAGCCCCGGACCTGCAAGCCTGGGTGTCCGT
GGGTCCGTCTGCCCAGCCAT 2014. chr13_SGCG_NM_000231_-1.67771
TTAGAATCCCCCACTCGGAGTCTAAGC 2015. chr13_ATP12A_NM_001676_-1.56649
ATTATGGTTACTGGTGATCATCCCATCACAGCCAAAGCTATTGCCAAGAG
TGTGGGGATCATTTCAGCCAACAGTGAAACAGTGGAAGACATTGCACATC
GCCTCA 2016. chr13_PABPC3_NM_030979_1.98426
GAAACTTTGACTGCCTCCAGGTTGG 2017. chr13_FAM123A_NM_152704_1.65484
ACTCTGCGGACCAGCACTTTGGAAACCGGGATTTTTGTTCTGGGCATCTC
ACTCCTGGAGGGTTGCTGGTGCACCACGGGATGGCTAGATGGAAGGTTGG
TCAGGTGCTTGATGCTAATAGGGATCTTAGAGTCCTTCAGCAAGCTGCCT
GGTGTTCGCAGTGGACAGGTGATGGTGCCTGGAGATACGGGCTTTAACCG
GGACAGGGAGGACGTCTCCTCGTTGTCCTTCCCTCCAGGAAGGGTTGCTG
GACTTCCGTCCGGGTCAGCATAGAGATCATAGAGCGCGTCCCCGCT 2018. chr13_ATP8A2_NM_016529_-1.7484
TGTCCCGGGCCACGTCTGTTGGAGACCAGCTGGAGGCACCCGCCCGCACC
ATTTACCTCAA 2019. chr13_PAN3_NM_175854_-1.5137
ATTCACATTTGGGAAACGAACAGGAGATGAGCAA 2020. chr13_MTUS2_NM_015233_-1.68042
AAGGTAGCCAAGGGAACCACATGGAAGTTGTGACAGCTCCCAGCGGCGCG
CCCCTTTCGTGTGTGCCGGTACCTCGGCTTAGGAGTTGCCCGCTGACACC
TTGAATGA 2021. chr13_MTUS2_NM_001033602_-1.61907
AAGATCTCACCGCCAGCCATGATGCTGCTCTCCTAGAGATGGAAAATAAC
CACACAGTTGCCATCACAATCCTGCAGGATGACCACGACCACAAAGTCCA
AG 2022. chr13_OK_AB064667_3.69709
AGGCGGCCCACTAGAAGGCGGCAG 2023. chr13_FRY_NM_023037_-1.66425
CGGAGCTAAAAGAATTACGGCACAAAGAGCAGAACCCATATGTGGTTCAA
AGCATTATCAGCTTAATAATGGGCATGAAATTCTTTCGAATTAAGATGTA
TCCAGTGG

Figure 3-164

2024. chr13_KL_NM_004795_1.77432
TCGTTTAACGACCGCACAGCTCCGAGGTTTGGCCTCTATCGTTATGCTGC
AGATCAGTTTGAGCCCAAGGCATCCATGAAACATTACAGGAAAATTATTG
ACAGCAATGGTTTCCCGGGCCCAGAA 2025. chr13_DCLK1_NM_004734_-1.71156
ATAAGTGATTACACCTGCTGCCCA 2026. chr13_POSTN_NM_006475_1.7366
GTGCCAGCAAAGTGTATTCTCCATCTGGCCTCAGAGCAGATGCCAAGCCT
AATTGGGCCACAAGATCCGTGAAGGTGGTTTGCTGTTTTCCAGCCAGCTC
AATAACTTGTTTG 2027. chr13_TRPC4_NM_016179_1.95759
TCATGCCATGCTATTTCTTCGTCT 2028. chr13_UFM1_NM_016617_-1.53831
TAAGATCACGCTGACGTCGGACCCACGGCTGCCGTACAAAGT 2029. chr13_FREM2_NM_207361_1.50537
GCTCTAGGCCGAGAATGGTATATACATACGATCTATACAGTGAGATCGAA
AGACAATGCCAATCGAGGTATTGGCAAAAGAACTGTCGAGTACCATTCTC
TGGTGAGTCAAGGAAAGCCCCAATCCACCACCAAGAGCCGGAAGAAGAGA
GAGATCAGGAGCACACCCTCACTGGCATGGGAGATTGGTGCTGAAAACAG
TCGAGGAACAAACATCCAGCACATTGCCCTGGACCGCACCAAGAGGCAGA
TCCCCCATGGGAGAGCACCTCCAGATGGCATCCTCCCCTGGGAGCTCAAC
AGCCCCAGCTCTGCAGTCAGCCTGGTCACTGTGGTGGGAGGCACCACGGT
AGGGTTACTCACCA 2030. chr13_FOXO1_NM_002015_-1.75089
GCGGGTGCTGCGACAGCGGCCCGGGCGGCGGGGGCTGCGGTGGCGCTGGG
TGCAGGCAGCCCGCCTCCGGGCCCTGGAAGTCCCCGCACAGCCCCCCGGT
GGCGGCCGC 2031. chr13_ENOX1_NM_017993_-1.69058
GGGGCAGGAACACTTTGATGGCTGAGTGCAGGGTCCCCTCGGAGGTCATC
AGATT 2032. chr13_NUDT15_NM_018283_-1.51483
TGACGGCCAGCGCACAGCCGCGCGGGCGGCGGCCAGGAGTCGGAGTCGGA
GTCGTGGTGACCAGCTGCAAGCATCCGCGTTGCGTCCTCCTGGGGAAGAG
GAAAGGCTCGGTTGGAGCTGGCAGTTTCCAACTCCCTGGA 2033. chr13_FNDC3A_NM_001079673_1.59847
TCACTTTAAATGATCTCAAGCCAGCC 2034. chr13_FNDC3A_NM_001079673_1.55148
TGAATCTTTACTTGTGCAGACTCCAGCTGTGCCTCCTGGCCCATGCCTCC
CTCCCAGATTACAGGGTAGACCCAAAGCAAA 2035. chr13_CCDC70_NM_031290_1.57579
CAGGACTGAAAGGGCACAGACAGGTCACTGCCAGCATTGTTGGGGCAAGC
CTGCAAGCACGCATCACTGGGGATCTGACATGACAA 2036. chr13_NEK3_NM_002498_1.50175

Figure 3-165

CTGGACAAGCCGAGCTACGATGCCTCGAGAGAGAAGCGTTGTAGCCGAGG
GGCGATGTGAGGGATTCCTTTTAAACATCTGCTTGACTAGGAACTGAAGT
TCATAGGAGTAATGAGACGGCAGTGGACTGATGCACCCTTGACATACTTT
GAGG 2037. chr13_KCTD12_NM_138444_-1.56355
AGTGGCAGGAAGCCGCGCTGCACTCAGGAGCTGCAACCGCCTTCCCCGGA
GCCCCGGAACCCGGACGCTCGCTCAGCCCTGCGCCCCGCCGCCGCCGCCG
CCGCCACCGCCGCCACCGCCACCGCCGCCACCTCCTAGAGCCGCGCGGAG
CCGAGCGGTGCGAGCGCGCCGCTGTG 2038. chr13_MYCBP2_NM_015057_-1.50558
GTTGTGACCTGAAGGTCCCGTCTTCACTACCTTGTACATGCCTGGCCCTC
CTCGCAAGAATGGCATATCTTGTTCTTGCATTGTT 2039. chr13_MYCBP2_NM_015057_1.59083
TGGCACCAGTATCTCGTCCACACTGTCCTTTATTATTTACACCAAATGTC
CACACCTCTCCATTCTTCATTAAAACACAAGTGTGAGCTTTGCCCATAGC
TAC 2040. chr13_SCEL_NM_144777_-1.87986
GAACCAGGTGTTCACCCTCCAATACCTCCAAAGCCCAGTTCTC 2041. chr13_SLITRK5_NM_015567_-1.61686
GGCGGGAAAGCCACCACTTGCGGAGCCCCGCCTACAGCGTCAGCACCATC
GAGCCCCGGGA 2042. chr13_GPC5_NM_004466_1.73634
TGTGGTGATGTTACTTCCCGGGATTTG 2043. chr13_SLC15A1_NM_005073_1.69122
ATCTGATCGGGCTGAATTTCAAGAGCTCC 2044. chr13_ZIC2_NM_007129_-1.62194
AGCCCGCGGACCGACCCCTACTCGGCGGCGCAACTCCACAACCA 2045. chr13_BIVM_NM_017693_-1.53612
TGCTATCCGACGACCTGTCGCCGGGCACCGCAGCATCCTCGCTCGCTCCG
ATGGGACGAGGGACGCC 2046. chr13_ARGLU1_BC071587_1.52993
GAGTGTGCTCCTCGGCTGCCATACGCGCCAGCTTCC 2047. chr13_COL4A2_NM_001846_-1.61467
CATAGGACCCCGAGGATCCAAAGGTGCAGTGGG 2048. chr13_COL4A2_NM_001846_-1.88239
AGCCCCCGGGATTGCAGGAATCCCCCAGAAGATTGCCGTCCAACCAGGGA
CAGTGG 2049. chr13_COL4A2_NM_001846_2.30006
GCTCCTGCCTGGCGCGGTTCAGCACC 2050. chr13_RAB20_NM_017817_1.52657
GGTCTCGACTCTGCAGATTGGGCTTTGCAGAGGATTCCTGTTTCCCACCT

Figure 3-166

CCCCACCCCTCTGACAGAGACTGAGGAGACCACACACGTTGACCTCCTCT
TCATAGCCAGCCATCATTTCCACTCCAACATTCTGCTGCGGGTGTCATTC
TGGAAAATAATTCCTTGCTGTTCCTTGCTCCTTTCAGATCACAG 2051. chr13_CARS2_NM_024537_1.57192
CTCCCACAGCATCGCTTCCCTGACGGAG 2052. chr13_CARS2_NM_024537_-1.61879
GGCCTGGGCCGCGCGTAGTCCTCAACAT 2053. chr13_ING1_NM_198219_1.53069
GCGCGCGCTGATCCGCAGCCAGGAGCTGGGCGACGAGAAGATCCAGATCG
TGAGCCAGATGGTG 2054. chr13_ARHGEF7_NM_003899_-1.6725
CCGAGCCCCGGAGCGAGAGCGAGTGCCTGAGCAA 2055. chr13_ARHGEF7_NM_003899_-1.73309
ATCAGGAACACTGAAGAGCCCTCCCAAAGGATTTGATACGACTGCCATAA
ACAAAAGC 2056. chr13_ARHGEF7_NM_003899_1.58192
CTGAAAGTCATTGAAGCTTACTGCACCAGCGCCAAAACAAGGCAAACACT
CAATTC 2057. chr13_ARHGEF7_NM_003899_1.73955
GCACTGCCGCATCCACCTAGAGGTGTTTGCTCTTGTCCGCTGTCTGAGTA
CTGTGATTCTCAGATGAGTTTGCTGCGTTTTGGGAGGACACAGACGGTTC
TGTATAGGCTAGTTCAGTAACAACAAAATACACTGTTTTGTCTTCCCTCA
AAGAGAGATCTTACTAGAACCTGTAAATAGAATGTATTATTTATTATAAG
TCACTGCAGCTGATGAAAACAGATGGAGGCCATGCTGCAGGCTGATACTG
ATGGGTGGAGTTTTGTCATCAGGCCAGCCTCATCCCGAGGTCTCCTCCAC
CATTGGCCGTAGCCAGCAGGCTTCAGTGCTCACCGAAAGTAAAATCCCCT
CCTTCAGCAAGAATAAAGCAATATACACCTTAGGTTCCACTAAGTAACAT
AGGCATAAGCAGGGAACGTTTCCCCCACTGTGTTCCAGTGCAGAGGAGAC
GAAGCCTGTCCTCACCGCGGCTCGCTGGGCCCAGGCTGGCTCTGGAAAGC
CTGTGCGGTCCTGGGCAGGAAGCCCGGCCCGTGGAGCAGGTTTTCGTTCT
GCTTCAGCAATAAATAAGGGTGACCACAGGGACTTTGCTTTTGGTTTCCT
TTCCTGTGAAAAGGTTGGTTTTAAAGTGAGATACACTTTTCCGTAGAACA
AGTGTTCTATCTTTAAAAACCCAAATTGCAGCACCGTGGATTACTGGTCT
CAGAACAACTCATTGCGCATCAGATTTGACTCTCTGATTTTCTGTCTATT
GGCCAAATTGCCCTTTAACTGCACCTGAATCCTTTGTGTACTGATGCCTT
TGAGCTGGGCACCTTGGGAGAGTGTTGTGTTGCTGTTTACGGTTCTTCCT
TGCCCTTGCTAATTACAGTCTCTGGTGCCCAGCAAGCCCCTTTGGCTTCC
TTCCGTGACTGGTCACGTTGTCTGCCTGGGCTCAGCGTGGACCTGCCCCA
TGCTGCAGAACCTGGCCTCACCTGGACTTTTCACTAGAATTGCCAGCTTC
CTCAACTTAGCAGATCATTCACTCATGCGGGCACAAGCAAAGATCAACAC
TTTCTTTTTTGGTAAGCTTGAGTTTTACAAGTTATTTTTTGGTGATGCGT
AAGACATTGCAGTGGGAAACCATTCAACTTGAGTTTATTGGAGTTTGCTG
TTGTAGCAGGTTTTAACTCAGGAACAACTCTTGTCTGATCTCTCCGCCCC
TCTGCCGGGAGGCGACATTAACTGTCCTCTCGGAGCCGGTAGCGTTGCTG
TCCGAGTCCCCAGGACGGATCTCCTGCAGACCTGCCTTAATGCTCAGATC
GAAGTATTTCACAAGAATACTTGTGTTTTTAACAGCCCTTCCCCTGGACG
GTGCGGCCATGAGGGCCTCATGTTACGGCATTGCCTTTTCTTTCTGTGGA
TCCAGTATCTTCCTCGGCTTTTTAGGGAGCAGGAAAAATGCGTCTGAGAG

Figure 3-167

CAACTCTTTTTAAAAACCTGCCCTGTTGTATATAACTGTGTCTGTTTCAC
CGTGTGACCTCCCAAGGGGGTGGGAACTTGATATAAACGTTTAAAGGGGC
CACGATTTGCCCGAGGGTTACTCCTTTGCTCTCACCTTGTATGGATGAGG
AGATGAAGCCATTTCTTATCCTGTAGATGTGAAGCACTTTCAGTTTTCAG
CGATGTTGGAATGTAGCATCAGAAGCTCGTTCCTTCACACTCAGTGGCGT
CTGTGCTTGTCCACATGCGCTGGGCGTCTGGGACCTTGAATGCCTGCCCT
GGTTGTGTGGACTCCTTAAT 2058. chr13_PROZ_NM_003891_-1.67905
CCTCGCCCTCCATCGTGTGGAGCCCTCAG 2059. chr13_PROZ_NM_003891_-1.64508
GGCCTCCAAAGCAAACGACGTTCTGGTGAGGTGGAAGCGTGCGGGCTCCT
ATCTTCTGGA 2060. chr13_CUL4A_NM_001008895_1.57931
CCCTATAGACCTCACAGTGAACATACTCACAATGGGCTACTGGCCAACAT
ACACGCCCATGGAAGTGCACT 2061. chr13_GRTP1_AK300897_1.86636
GAAATACCGCCCACGTTTGCCATGCTGCACCCAGAGTGGCCCCGAGCCTC
CACTCCCTCTTAGGAAACTACTGACTCCCAGGCCTGAGCCTCTCCTGCCC
TCTTGGCTTCCTCAGAAGGCCTGTCAGGTACAGCTCCCACAACGCCCTCA
TCAGGACCTGAGTCTATACGGCCTGCGCCAGGTCCAGGACCCAGTGGGGA
GGCCGGGCCTCGGGAAGCCACACTTCTGGCACCACACACAGCAGATGAGT
ACAGCCATTAGGACCAGGAGCAGCGTCCGCAGTGCCAGGGCCAAGAAGAC
AGGGCCGCCATAGACAGGAAAGCCCTCGGAGGCC 2062. chr13_TMCO3_NM_017905_1.72925
GCGAAGAGCGGGCGTCATCTCTCGGGAG 2063. chr14_OSGEP_NM_017807_1.51497
TCTCATCTGTAGCAAAAAGCCGGGCTCCACGTTCCTGGCACATTGTTGCC
ATCATCTCCTGTAGCCTCACATTA 2064. chr14_METT11D1_NM_001029991_-1.76123
GGATGGTGGCTTTGCAGCAGTCTCC 2065. chr14_---_---_-1.60752
AAGGAACAGATATGATTGCTAGGCAACAGAGTGAAGGTGCATTTCAGAGA
ACTG 2066. chr14_HNRNPC_NM_031314_-1.62938
TGAGTAGAGGGGACGGAGAAGGGTGTTCTGTTACTGAC 2067. chr14_---_---_1.50697
TCTTGCCTTGTTACTCCCTTTACATCTGGAAGGTGTAAAAACCACTTG 2068. chr14_SUPT16H_NM_007192_-1.66328
CACTCTCCCAATGACCCGGAAGTATCGACCTCAAAGATGCCCTTTCCGCT
TCCGGGTCCCAACAGCGTTAGGTTTTTTTTTGTTTGTTTGTTTGTTTTG
TTTTTTTCCAACCCTCTTTCGGATGGACGGGGGAAAGAGAGAAAGAAAAA
CGAGGGAAAATCAACAAAATGTGCGATGCAAAGAGTCGATTTTCGCGGGG
TTTGTCAACTTCGCCACTGCCGCACGCGAATCGACGTCGT

Figure 3-168

2069. chr14_---_---_-1.72679
AAAGAAGTGAAAGCAGGATCTCGGCCAGGCACAGTGGTTCACACCTGCAA
TCCCAGCACTTTGGGAGGCTGAACCAGGCGGATCACCCGA 2070. chr14_SLC7A7_NM_003982_1.93388
GAGAGGAAACCCTTCACCAGCTTCC 2071. chr14_MRPL52_NM_181304_-1.66984
TATAGATAGGGACCGTGGACTCGGG 2072. chr14_SLC7A8_NM_012244_-1.5316
CAGCGACGGCGTTGGATGCCAGCAGCTCCTGGGGGGACATTGCAGTGACA
TAAGCGACATTGGCAAAGACATACACAAATGTGACCAGTGGGATGGAG 2073. chr14_SLC7A8_NM_182728_1.89285
GCAAAAGGGGTGAGGCATGTCCCTCC 2074. chr14_HOMEZ_NM_020834_-1.65585
AGGTACTGCGTTGTCCCGAAACCACTTTAGTTGCCCATGCTTCAAGGCAT
AGCGTGTGTCACCAAACCACTGAATGATCTCAGGCCGAGGTAAACCAGTG
ATCTGTTCTAACTTTTGGTAATCCTCACGCCGTGCCCACTGGCACTGTAA
AAAAAAGGATTTAAGGATAGCCAGCTGCTCT 2075. chr14_EFS_NM_005864_-1.70128
GTTGGCGGGCACAATGCCCTGCTGGCCGTGTAGGGAGCAGAGGCACCAGC
CGTCCAGTCCACCAGCGCCCTCTCTCTGCAGGACCCGTAGGACATCCCCT
CGGCGGAAGGACAGCTCCTGGGGGGACTCAGCGGTGTTGTCATACAGTGC
CCGGGCCA 2076. chr14_MYH6_NM_002471_-1.78985
GGTGGAGAGCCGACACCGTCTGGAAGGATGAGCCCTTTTT 2077. chr14_LRRC16B_NM_138360_-1.54502
CGGACTCTGAGGACCGTGCGGCCAGGACTCTCGGAGGCACCGCTGCCTCC
ACTCCAGAAGAAGAGGCGCCGGGGCCTGTTTCACTTTCGCCGGCCCCGGA
GCTTCA 2078. chr14_FITM1_BC042179_-1.51452
AAAGGGCACGGCAAGGAGAGAACGAGTGATGATGTGTAGGGTTGGGGAGA
GTGCAGTGATGGGAGCACAGACCAGGGTGGGAGATGGAGCTTGGGGTCTC
AATAGTCTCCCTTCTTTGCC 2079. chr14_RNF31_NM_017999_1.50571
ATACTCATCCAAGACAGCAGGCACTG 2080. chr14_IRF9_NM_006084_4.15274
CAAGCAGGACTTCCGGGAGGACCA 2081. chr14_IRF9_NM_006084_1.73382
CCACCGAAGTTCCAGGTAACACTGAATTTCTGGGAAGAGAGCCATGGCTC
CAGCCATACTCCACAGAATCTTATCA 2082. chr14_TM9SF1_NM_006405_1.61685
CCTGAGGGTTATGGTAGGGTCCCACTTTGTTGACATACAGAATAACAGGG
TCGCCGGCCTTGTAGTGTGTCACGCCTTCCACCC

Figure 3-169

2083. chr14_LTB4R2_NM_019839_-1.50313
GGACCGCGTATGCCAGCTGTGCCACCCGTCGCCGGTCCACGCCGCCGCCC
ACCTGAGCCTGGAGACTCTGACCGCTTTCGTGCTTCCTTTCGGGCTGATG
CTCGGCTGCTACAGC 2084. chr14_RIPK3_NM_006871_1.60968
AGTCCTTCTAAGCCGGGAGTCTCAGGCCCCGGCTTGGGGCAGCTCAGCCAA
TGAAGGCCGGTT 2085. chr14_KHNYN_NM_015299_3.05619
ATGCCTCTCCTCCGAGGGTGCCCA 2086. chr14_STXBP6_NM_014178_-1.52928
CAGCCACGTTGCCCGGCGGTGTTGGTGAGGCTCGATGCCGGCGTGCACGG
CAAGCGCGAATTCGGAACCTGGCGCCCTTGAC 2087. chr14_PRKD1_NM_002742_-1.61657
GTTGGCGTCCTCGTGGTCTGGGTCTGGATCTTGCATCTCGCCACTGTCGT
TCTGGCACTCTGCCATTGCCATCTCTGCATCTTGGACCATTGCTTCTTCC
ATATCATCCATGAGCCCACTGTTC 2088. chr14_SCFD1_NM_016106_2.19068
AGCAGCCAGTATTCGGGAAAGGCAGACAG 2089. chr14_SCFD1_NM_016106_-1.54149
TTGGAAGATGATATGTTTGTATTA 2090. chr14_HECTD1_NM_015382_-1.58856
CAATCCTTCGGGTACATTCCGCAGATACATCCAGGTAGTATGTTATGGCA
CGGGCTGTCACCTCTAATACA 2091. chr14_PPP2R3C_NM_017917_2.00666
TGCACTTTGCTCCAGCCTTTTCACC 2092. chr14_BRMS1L_NM_032352_-1.64522
TGCCAGTCCATTCCCGAGGGGATAAGAAGGAGACCAACCATCACGATGAG
ATGGAGGTGGACTACGCCGAAAATGAGGGGAGCAGCTCCGAGGACGAGGA
CACTGAGAGCTCGTCGGTCTC 2093. chr14_FOXA1_NM_004496_-2.16142
AGCTGGCCGGTCTTCCCGTGCACACCCCGATGGAGGGGCGAGTCGGCGCT
GGGGTTAGAGGCGCCAGAGGGGTCCTTGCGGCTCTCAGGGCCGCC 2094. chr14_SEC23A_NM_006364_1.52946
TGGCATTGGAAATCTGGAGTGAAGAATTTCCTGTGCATCATCCACTGGGG
CTTGCAGAAGGTGGCGGAAATTTTCATACTCAGGCATATCCTGGTATCCT
GACTTCCGCCACTGTG 2095. chr14_PNN_NM_002687_1.60916
GGATAAGAATTCCCGGTCCGACAGAAAGAGGTCTATATCAGAGAGTAGTC
GATCAGGCAAAAGATCTTCAAGAAGTGAAAGAGACCGAAAATCAGACAGG 2096. chr14_PPIL5_NM_152329_-1.57598
TTCACCAAATTTGTAGATGAGGGGAAAGCCACTGTTCGGTTAAAGGAGCC

Figure 3-170

TCCTGT 2097. chr14_ARF6_NM_001663_1.69888
GGATCCTCATGTTGGGCCTGGACGCGGCCGGCAAGACAACAATCCTGTAC
AAGTTGAAGCTGGGCCAGTCGGTGACCACCATTCCCACTGTGGGTTTCAA
CGTGGAGACGGTGACTTACAAAAATGTCAAGTTCAACGTATGGGATGTGG
GCGGCCAGGACAAGATCCGGCCGCTCTGGCGGCATTACTACACTGGGACC
CAAGGTCTCATCTTCGTAGTGGACTGCGCCGACCGCGACCGCATCGATGA
GGCTCGCCAG 2098. chr14_ATP5S_NM_001003803_1.65023
GGTCTCTGAGCAGCGACTCACCTGTGCAG 2099. chr14_MAP4K5_NM_198794_-1.69322
GGCGGCCCCGTCTTTGTTGAGCGCGGAGCCCG 2100. chr14_NIN_NM_182944_1.63472
TAGGCGTCGCAGTGGACCTCAGGTGCTGCAT 2101. chr14_SAMD4A_NM_015589_-1.56681
TGGGCAGACGGAACCCGCGCCAGTACCAGATCCCCTCTCGGAACGTCCCT
TCCGCCCGCCTGGGCCTCTTGGGCACCAGTGGATTCGTCAGCTCCAACCA
GCGCAACACCACAGCTACC 2102. chr14_LGALS3_NM_002306_1.97707
CGCCAGCAGCCGTCCGGAGCCAGCCAACGAGCG 2103. chr14_PSMA3_NM_002788_-1.50935
AGTAGCAGGTTTGTTGGCAGATGCTCGTTCTTTAGCAGACATAGCAAGAG
AAGAAGCTTCCAACTTCAGATCTAACTTTGGCTACAACATTC 2104. chr14_DACT1_NM_016651_1.58303
TTAAGAATTCGAAACAGGCGTGTCTGCCCTCTGGCGGGATACCTTCTCTG
AACAATGGGACATTCTCCCCACCGAAGCAGTGGTCGAAAGAATCAAAGGC
CGAACAAGCCGAAAGCAAGAGGGTGCCCCTGCCAGAGGGCTGCCCCTCAG
GCGCTGCCTCCGACCTTCAGAGTAAGCACCTGCCAAAAACGGCCAAGCCA
GCCTCGCAAGAACATGCTCGGTGTTCCGCCATTGGGACAGGGGAGTCCCC
TAAGGAAAGCGCTCAGCTCTCAGGGGCCTCTCCAAAAGAGAGTCCTAGCA
GAGGCCCTGCCCCGCCGCAGGAGAACAAAGTTGTA 2105. chr14_SIX4_NM_017420_1.60881
GGATCTGGACAATGCCATACTGGTTAATTTGCACTGGTGTAGTAAAAGTC
ACTACAGACCCTCCATCTTGGGAAGCCACTGTTTGAATGCCTTCTCTTTT
CACCTCAGTGCTGGGTATCAGGCCTGGGAATGAGACAGGGACACTGGGGC
TGTAGGACGTGGTGGTTGCTGAGTTAGCAGAACTCTGGAGGACTTTGAAT
TCCTTCACGTCCTGGGAAGTAGACCCCAGTATGTCAGTCATGGATATACC
ATTGCTCACAATGTTTGATGACATTTTTGGTGGGTTCAATGCCACTGCCT
GTGTATTTCCCACATTTAATCCATTAAGGATAACTCCACTGGGTCCCTGA
ATAAAAGAATTTCCATTAAGGAAGACAGGTGAAGTACTTGCAGGTACCAA
GCTTCCATTCAACAGAACTCCAGAAGAGCTTAATGATATCTTAGCATTTC
CAATTTGTTGCATATATACTGGCTCCATATGACTGGAAAGGCTGAGGTTG
GTGATGCCATCAGATGAACTGGAGAGTGGGTGAGGAGATAAATCCTCATG
TCCCTTGCTGG 2106. chr14_SLC38A6_NM_001172702_1.61225

Figure 3-171

AAGGGCCGGGCTCAAAGCTCCGCCTCTGGCGCGACCGACGACTGGAGCGC
AGGGCA 2107. chr14_HIF1A_NM_001530_-1.68166
GGCCGCCCGCCGTGAAGACATCGCGGGGACCGATTCA 2108. chr14_ESR2_NM_001437_1.51473
CATCAGGAGGTTAGCCAGGCGCATGGATTGCTGCTGGGAGGAGATGCCGC
TCTTGGCAATCACCCAAACCAAAGCATCGGTCACGGCGTTCAGCAAGTGA
GCCAGCTTCCGGCTGCTGTCAGCATCCTGGGTCGCTGTGACCAG 2109. chr14_RAB15_NM_198686_-1.55538
GATGGTGGAGATGTGCGAGGAGTGGAAC 2110. chr14_RDH12_NM_152443_-1.53583
CTTTGCTGGTGGAGTGTGTAGAACAAATGTGCAGCTTCCTGGCAAGGTAG
TGGTGATCACTGGCGCCAACACGGGCATTGGCAAGGAGA 2111. chr14_ZFYVE26_NM_015346_-2.04816
TGCAGCCTGGTGGACAATTTCTTGGA 2112. chr14_ACTN1_NM_001130004_-1.68934
TGTTGCATGGCATGCATGGTGTTCTCGGGCACCCGGTTCTCCAGCCACGG
GATTGTGCGGCGGATCCAC 2113. chr14_DCAF5_NM_003861_-1.57716
CATCATGGAGGATAACTTGCTCAT 2114. chr14_----_----_1.52075
TCATTTGAACCAAGAAGGCAGAAG 2115. chr14_SLC10A1_NM_003049_-1.67966
AGGCTGTGCAAGGGGAGCAGTCCTCCCCTTTGTAGGTGCCATTTCCCAGA
GCTCCTGGAATTGTTTCTTCAGTTGTGGCAGCTGTGTAG 2116. chr14_SMOC1_NM_001034852_-1.78077
GAGAGCGACGCCAGGGCCAAGACTACAGAGGCGGATGACCCCTTCAAGGA 2117. chr14_SLC8A3_NM_033262_-1.50021
CTCCCGAGCGGAGTGGGCAAGGGAGGGGGGTGAGGAAGGTACGCGATGCC
CCCGCCGCCCGGCGCCTCACCGGTCGCAGCGGCTCATCGCCCCCGCGGGC
TGCCCGCCGGCCGCAGCCGCGTCCGGGGCATGTCAGTCCGCCGCCGCCGC
CCTCCCGCCGGGGTTCGTGGGCTCGCAGCTGTCAGGGAGCTGCGG 2118. chr14_MAP3K9_NM_033141_1.65681
AAGTGGAAATGTGGAGATTCTGATGGGGTACTTAAACCATTAGCTTTCTC
A 2119. chr14_MAP3K9_NM_033141_-1.67357
CTGAATGGGCGGGTAGCAACTGGGGTCCTCGCCGCCGGGCTGGCAGCGGC
TGGAGAAGGCGCTGCGCGGGGTCACGTAGTTGCTGGG 2120. chr14_ZFYVE1_NM_021260_1.61819
GATAGGATTTCAGCACAACGGGCCCCTTTCCAGTCATGACAGACAGAGATG
TCCAGGCTCTTGAGGAGAAACAAAAGTTCCTTTGACTTCTCTTGCAAGGA

Figure 3-172

CCAAAGAGATAAATTTTTTCTTTACGATCTGTTGAAATATTTATATAGAC
TTTTAAAAACAACTAACAGTTCATCCTGTGCTCAGTTTCCCTGGAAGGTT
TCTCATGATCGCCCCTCCGAGAGCTAGAGGGGTTGTGTGTCTGGGAACAA
AGGATTAAGACACTTTAAAATAAGCAATGAAAATCCTAGTGCGACACTCA
GAAGCAGATGGTGGGCTTGAGGGGGCCGAGGGGTGGGAGGCAGATGCTTC
GATTGAGGAGCTGGGTGCCGCCTTTTGGGAAAGCCGAGTGGAGACAGAAG
CATCGGGACAGGAAGCCCTGCTGGAGAAGGCTCAGTTCCTTCCTTGCTGT
TCCCTGGGGGACCAGGGACAGCACGGCCCCTGCATTTCTACTTCTCAGGG
CCGAAGACCCGACCTCTGACCCTCCACCCACTCCGGTGACCTGCACGCTA
AGTTGGGTGGTCTCTGACTAAAACAGGCTTAAGCCAAGAATTGGGACTCG
ACTCCCAGGAGACCTAGGGAGAATTCCCTTCAGGCTGTTTCAGGCAGGAA
GGACCAGGGAGGCTCACTCCCCAGGCAGCTGACAGGCATGGAGGGAAGAG
CCAAGGACAGGAGAGGCTTCCAAGGCTCCAAGAGCAGCAGAGGAAGGGGC
CAGCCACGTGGTGGCCATGGACCTGGCTCGGCTCATGAGGAAGACGTGCT
GCCACTGCCACCTCACCCTGTGCGGAGGAGACTGTGCGAAGTCTTCACAG
CCAGCAGCAGCCTCGATACGCCCCGAGTGCCTTTCATATGTATATATGAG
AGAGAGATATACACATATATATTCATTATTTTTAACTGAAATAAATGCAA
CGGATTCAGGTTCATTCCCCTTTGCGATAAGTTGCAAGGTCCCCTGCCCT
GAGGGGTCCACACCTTCGGGCCTGCCGCCAGGCTCACCCCCACTGAGGGA
AAGTGGCCCTGGATGCGGAGAGGAGAGGACACACACCACAGCAGGTGACT
GGGAGGAGGGCCTACCTCGCAAGACTGTTT 2121. chr14_COQ6_NM_182476_1.574
CAGACACCTTGAGTTCCTTGGTTTGGTCCACGTCCCATGAACATGCAGCA
GAGCTAGTTAGCATGGATGAGGAAAAATTTGTGGATGCCGTTAACTCTGC
CTTT 2122. chr14_LTBP2_NM_000428_-1.62114
TACGCAGGCCATGTGGGCCGCATCCAGCTGGAAGCCCTCAAAACAGTCAC
AGGTGTAGCCCTCCCGCACGCGCACACAGCGGCCATTCTCACAGCCGTTC
AGGATGCCGCACTCCTCCGCCTGAAGCCCTTCGAAGCCGGCTGGG 2123. chr14_LTBP2_NM_000428_-1.89516
CAGCCGCTGCCGGGTAGCTGCCCCCAGGGCGCCGCAGTCGATTCGCGTCT
CCACCAGCCGGCTCGTATCTCCCT 2124. chr14_MLH3_NM_001040108_1.54614
GAATCATTCCTTTGGTGAAACGATAGGGATACAAGATGTTGTGAATTTTA
ACTGCTAAGCTCTCAGCCTGGCCACTGCTTACATCAACAGCAA 2125. chr14_NEK9_NM_033116_-1.75906
CTGCACGCACACGCAGGAGGAGTCAGTGGTGTTCCCTTCCCAGCACAGGT
TACTGCAGGATTCAGCCGAGGTGA 2126. chr14_ADCK1_NM_020421_-1.545
GTTCCAGAGCTTCGATGACACCCCTCTGGGGACGGCCTCCCTGGCCCAGG
TCCACAAGGCAGTGCTGCATGATGGGCGGACGGTGGCCGTGAAGGTCCAG
CACCC 2127. chr14_NRXN3_NM_004796_1.84423
TCGAGAGGAGAATGTGGCCACTTTCCGAGGCTCAGAGTATCTGTGCTACG
ACCTGTCTCAGAACCCGATCCAGAGCAGCAGTGATGAAATCACCCTCTCC
TTTAAGACCTGGCAGCGTAACGGCCTCATCCTGCACACGGGCAAGTCGGC
TGACTATGTCAACCTGGCTCTGAAGGATGGTGCGGTCTCCTTGGTCATTA
AC

Figure 3-173

2128. chr14_CATSPERB_NM_024764_1.73218
CAGTAACCAGATATGGAGATTGCAA 2129. chr14_CPSF2_NM_017437_1.52353
CAGATATAGATTCCAGTGATGAGAGTGATATTGAGGAAGATATTGACCAG
CCATCAGCTCATAAGACGAAGCATGACTTGATGATGAAAGGTGAAGGCAG
TCGTAAAG 2130. chr14_CPSF2_NM_017437_-1.56256
ATGGCCCACCAGAGGCCAGTCAAGATCTGGCAGAGTGCTGTCGCGCCTTT
GGTGGGAAAGATATTAAAGTGTACATGCCAAAGCTACATGAAACAGTTGA
TGCCACTAGTGAAACTCACA 2131. chr14_CHGA_NM_001275_2.283
GCTCTTCTGCTCTGCGCCGGGCAAG 2132. chr14_ITPK1_NM_014216_1.73589
CAATGACGGCGTGCTGCCCTGTCTGGTTGTTGATGATGATGTCGATGCCG
AAGAGTGACACGCCCAGTGCCTGCCGCAGGGCCCGGGAGAGCTCCCGGAT
GACCTCGTCGCTCGGCCGCTCGAACACGCCCTCGATCTTGTCCAG 2133. chr14_OTUB2_NM_023112_1.53365
GGGAACACATGACATGATTTGTGAATATCATCATCTTTGCCAGACAAGTC
TCCAGGGGATCCCTGTTTCCCAACTGAAAGGTGTGAACGGACACACACAC
AGCCTGGATGACGCCTTGGCTGTTCTA 2134. chr14_IFI27_NM_001130080_-1.778
CAGCGAGGAGCCAACTATCCCAAA 2135. chr14_SERPINA9_NM_175739_-1.55125
CATTGGCCGGGGACACACAGTAGATTGGAGCACAGAGGCCAACAGCAAAG
AGTACTCCATAAAGGTAAGA 2136. chr14_SERPINA13_NR_015340_1.51258
TGATGACTTTCCACACGGAAACAGGAAG 2137. chr14_DICER1_NM_177438_-1.50092
AACTGCGCTCGATCTGGATTCCAGTGATCCTCTGCAGTGCCCACCTGCCT
CCAGGGAGCGACTGAAGAAGCCGACTGCCGGGGGAACACCTGGATTCATG
AACCAAAGCAGCCTCAAGTTTCATGTTGTCAAGGCAGGGTATCAGAATCT
TTCTGAGGGCAAAGTATTATTAACAAATAAAAATATCAGTATTTTAAAAG
ACAATTACAGGAGTGTTAGAGGTCATTCTAAATTTCATCACTTCACGTAA
TATAAAAGAAAAAAGAAAAGAAATATAACAAACATTTTAAAAACATAATT
AAGAGTTCAGTTAACAAATCTGTTTCATACTTTCACAAACAGTAAAAATG
CCACAGACAAAAATGACCTATTTAAGTTGTGCGAGTATATGACACATTGC
AGGCATTATAATTATCTTTTTCAAATTCCATAAATCAAAACAGCAGCAAG
GCCAAACCACATTTTTTTCCTCTCTGTTAAGCATATTTTCTTGAAATGAG
GTAAAGCATGGTACCAAGTGCAATGCTTATCTGTGCTACATGAACAGAAC
AGAAGGGAAAAAGCTATTATAAAACGCAGCATAGTTAGGACTGCGGAAAG
CATATTATAAAAGAAATTTTAAAAAATTTACAAATGAAGGTTCATGTTAA
CTAACTTGCACACAATCATCATAAGGAATTTCTGCAGTTGCTTTTTCAAG
ACACGCCTCCCCAGTCCTTTACACACGTGCTCAGGGCACAACCACACCCC
ACTGGTAGGTTTTCCATATTACATTCGGTCTCACATTGCAATCACAGGAA
CACAGGGTGGCACACAGGGCTCTAAA

Figure 3-174

2138. chr14_GLRX5_NM_016417_-1.58231
GGTGGTCTTCCTCAAGGGGACGCCGGAGCAGCCCCAGTGCGGCTTCAGCA
ACGCCGTGGTGCAGATCCTGCGGCTGCACGGCGTCCGCGATTACGCGGCC
TACAACGTGCTGGACGACCCG 2139. chr14_C14orf132_NR_023938_1.54305
TGGGCGTGGTGTATGCCTTCACCTTC 2140. chr14_CYP46A1_NM_006668_-2.13217
GGAGCAGGCCACACTCAAGCCACTGGACCCCGTGCTGTGCACCCTGCGGC
CCCG 2141. chr14_EML1_NM_001008707_-1.52971
TGGAGGAACCAATCTCTGTGCTGTGGATGACTCCAACGACCATGTGCTCT
CTGTATGGGACTGGC 2142. chr14_------_------_-1.52496
CTTGTATTCACAGGAAGGCAGTGGGAGATTGACTGCCAA 2143. chr14_WDR25_NM_024515_-1.71332
CCTTGCACCCGAGAGAGCCCGTGTTCCTGGCACAGACCAATGGCAACTAC
CTGGCCCTTTTCTCCACTGTGTGGCCCTACCGGATGAGCAGACGGCGGC 2144. chr14_DLK1_NM_003836_-1.62143
CCCCTTTGTGACCAGTGCGTGACCTCTCCCGGCTGCCTTCACGGACTCTG
TGGAGAACCCGGGCAGTGCATTTGCACCGACGGCTGGGACGGGGAGCTCT
GTGATAGA 2145. chr14_DIO3OS_BC065701_2.7671
TCCTGCCCGAAGCCTCAGGAGGTC 2146. chr14_WDR20_NM_181291_-1.52824
GCCGGGAGCTGTACTTCTATATCTACAAGGGGGTCCGCA 2147. chr14_WDR20_BC030654_1.53672
TGCCCTGCCTCCGGTGCCGGTGGATGGGGGAGGGACTGGCCTCTGACTGC
GGGGTTGCACCATGGCGGCGGTCG 2148. chr14_CDC42BPB_NM_006035_-1.5992
GCCGGACCACGCGGTGCTGCTTCTCCAGCCCCCGCAGCCGCTGCGTGGAG
TCCTCACGCTCTTGGCGAAGCGCCACTGTGTCCTCAAGCTGTCGCTCGAG
C 2149. chr14_TNFAIP2_NM_006291_1.55271
GCCAAGGCCGAGAGCATCACGCTGGACTTGG 2150. chr14_CKB_NM_001823_1.68294
CATTTCTGGGCAGGCATGAGGTCGTCGATGGCCTGGCCCTGCTCCAGCCG
CTGCTCCATCTCGATGAGCAGCTTCACTCCGTCCACCA 2151. chr14_XRCC3_NM_001100119_-1.59666
TTCTGGGATTCAGGTCCAGTAGATCCAAATCCAT 2152. chr14_TDRD9_NM_153046_-1.51245

Figure 3-175

TTTTGCAATGCCTTTCCGGCAGCATCTCGATGGATATAG 2153. chr14_KIF26A_NM_015656_-1.6051
GTCGGCCGAGTACCTGGCGGCCCTGGAGCGAGCCACGGCGGCCCTGGAGC
AGTGCGTGAACCTGTGCAAGGCGCACGTCATGATGGTCACCTGCTTCGAC
ATCAGCGTTGCAGCCAGTG 2154. chr14_INF2_NM_022489_-1.86065
CTGGAACAGCCCCTCGCAAGCAGCAG 2155. chr14_INF2_NM_022489_-2.00013
TGCAGGAGATCCCGTGGGCAGCACGCGCTGTCCCGCCTCTGAGCCCGGCC
TTGATGCTACAACAG 2156. chr14_AKT1_NM_005163_1.92755
AGCCTCACGTTGGTCCACATCCTGCGGCCGCTCCTTGTAGCCAATGAAGG
TGCCATCATTCTTGAGGAGGAAGTAGCGTGGCCGCCAGGTCTTGATGTAC
TCC 2157. chr14_AHNAK2_NM_138420_-1.51484
AAGAATTTCTGCTGGCTCCTCATCTGAACAGCTGTCTGCAAGCTGGTGGC
CAGAAGGAACTTCAAATGTGAGTGTTTGCTGTCCCAGTACATTGACGCTG
GAAGAGATCATCTCAAATGGTTCTCCAGTGTCAGGCTGGAGATCTCCAGA
AATGGAGTCTACTCCTGGGGTGGCTTGTATGGGAGCCTCTTCTGTGCCCT
CCTGAGTCCTAGAGTGTTGAGTCA 2158. chr14_JAG2_NM_002226_-1.61726
GTGAGTGCAAGTACGACCCTCCCAGCCGTCC 2159. chr14_C14orf80_NM_001134875_-1.92359
CTCCTCTTCCGTGTGCTCTCGCCACTCCCTGCGGGC 2160. chr14_IGH@_BC065733_-1.57536
ATGCGACGACCACGTTCCCATCTTGGGGGGTGCTGTCGAGGCTCA 2161. chr14_IGHD_BC063384_-1.70774
AGGGGCTGGCGCATCTTCCTGCACACAGAAGAGTCCAGGGTGGGTCCTTT
CTGCTCTCTGGTAGCCACAGATGAGGTACAGAGGCTGCTTCCCTTCTCTG
CAGGTACAGGGCGTCCTGCTC 2162. chr15_NIPA1_NM_144599_1.55895
GCCCACCACACAATGTCTGTTAAATAGGAAG 2163. chr15_GOLGA6L2_BC129821_1.83284
GGGCACTGCTGGGCGTTCTTCATCCCACAAA 2164. chr15_SNURF_ENST00000401453_-1.56419
AAACTCCTGGATCAATCTAGACTCCTGCCTCAGCCTCCCAAGTGCCTGTT
AGTACAGGCTTGA 2165. chr15_ATP10A_AB051358_-1.59393
CTCCATCCTGGACGGCGAAACGACCTCGGGAGACCCCGGTTAGGACCTTA
CTCCAGGGATCAACTGGAATCAAAATCCAA 2166. chr15_HERC2_NM_004667_-1.55604

Figure 3-176

TCCCATCAGCCGTCACAGCAAAGAGGGTCTGTTCCCCTCCGATTAACTGC
ACGGGTCTGAGAGTTGCAAGGGCTTCACAGGGAGTGGGAACTTTGACTTT
TGCGCCTTCAATGCCCCCGAGCTGGCCCCTGTGATTATGTCCCCAT 2167. chr15_HERC2_NM_004667_-2.41978
TCAAGAAATCAGCTCGTTTTTTGT 2168. chr15_TJP1_NM_003257_1.77638
TTTTGTCATGTTCACTGAATTGAT 2169. chr15_KLF13_NM_015995_-1.51836
CATGCGCTCACTCTTCGGTGCCCGGCCGGGCCGGCGCCTCGCAGACGCGG
AGCCGCGCGGGTGACGGCACAGGCGGCTGCGCGCCCAGCCCAGCCCAGCC
CAGCCCGAGGAGAGGGCGCGCCGCGCCCCCGCCCCCCGCCCCGCTCTCCCG
AGGCCGTGGGTGCGGATGCGCGGCTGACGACTCGCAGCAA 2170. chr15_OTUD7A_NM_130901_-2.09875
ACGTGCTGGCCGACGCACCAGACTCCTCCTTGCTGCCCTTGCGCGACTTG
GCCTTCTTCTCCTTGCCCCGCTCGGCCGAGTCCCCGTTCTTGCCATTGGC
GGAGTTGGCGCGGCCCATCTTGCCGTGCA 2171. chr15_C15orf55_NM_175741_-1.70798
GCATTGCCGGGACCGGATATGAGCATGAAACCTAGTGCCGCCCCGTCTCC
ATCCCCTGCACTTCCCTTTCTCCCACCAACTTCTGAC 2172. chr15_THBS1_NM_003246_1.56705
TGCAAAAAGGTGTCCTGCCCCATCATGCCCTGCTCCAATGCCACAGTTCC
TGATGGAGAA 2173. chr15_GPR176_NM_007223_1.68922
CAGCCCACTCGACAGGAATGGAAACACAGAAGGAGGCATTCGATGGTCAA
GGAGGGCGCTCTCCGCTCCCGCTGCCTCCTTCAACCGCGGGTCCTCCGCC
CCTCGAGGGCTAGGGCATCCCTCTCCAGTCCCCTCGGGCTGACGCACTCG
ACCCCTCTCCTTAGCGGGAGGAGAACGTTTGGCCGAAGCTATTTTTCAGT
CCTGTTGGCTTCGAGGCTGGATGGCGATGTGAAGCCAACGTAATGCCC 2174. chr15_BMF_NM_001003940_-1.5891
TCGGGGGCTGGACGCCCAGACTCGATTGGGAAGGA 2175. chr15_PLCB2_NM_004573_-1.55249
GCACGCGCCCGTCCACGCCCTCAGGGCCCTCGCCCGGCGCGGCTCCGGCG
CTCTCCTCGCGGGGCAGGCT 2176. chr15_DISP2_NM_033510_1.63704
GGCTGGAGCCCGAAGGTATTTCTCCAGATCCACAGGGAGAGGTCTCACCC
TCCAGCTGTGGATGTTAAACCCTGCCAGATGTCCCAGCCTTGATCTGTCT
GCTCCTACTCCTCACATCTGGAGGATTCCAGCAGGAGGGGTTTTGGAGGG
GACCTGCTTGCGACCTGCTGAGGGCTTGTCTGCTCCCACAGCACCATCTA
AGACCCCTCCTCTAGAAGTGGGGAAGGCCAGATGTGTAGCTTCGGGTATC
AGAGGAGGCTGACCTGGCCCCCATCCCAAGTTACAAGAACTTCAGTGAGA
CTAAGGGACCCCCATCCTAGGGATCTTGTCAGGGTTCCTTACTGACCAGA
GGAGCCCGCAGCAATCTCCACAGCCTCCTGGGTCTCACCCCTTTCATGGG
CTCTTCATCAGGACACTTCCCTCTCTTTTGGGAGCTTCTCTGGGCAGAAT
TGGGCTGGGACCTCTCTCCCCAACTGCCCTGCTCTCCTCATACTCACCGG
TTTGACCAGAAATTCTCCAAATCCAGCCATAGATGGCTGCTGGGTGTGCA

Figure 3-177

GCAGGAGAAGGAGGATGGTCAGCCTTGGAGCATCTCTCAATTACGGGACA
G 2177. chr15_IVD_NM_002225_-1.57874
GGAACCTGGGCGTATTGGGCATCACAGCC 2178. chr15_FAM82A2_NM_018145_1.56693
TCTGTGAACGTGGCTCCCGAGGAGGCCGTGAAGTAGACAGAGCTGGAGCC
AGTGGAGTCACTCCTCTCCCGGACAAACGG 2179. chr15_ZFYVE19_NM_001077268_-1.6445
GTGGCCCAGGGAGCACTAATTCCAAG 2180. chr15_PPP1R14D_NM_017726_-1.90245
TCTGAGGCCGGCTGAGTCTCCGGAGTTTCTTG 2181. chr15_RHOV_NM_133639_1.51407
CGTGCGGATCTCGGGCAGCCATTTCTCTGTGATGTTTTGAAAGGAGCTGG
GCTGCACCACGCTGAAGCACGCCAGGAAGACATCGGTATCCGGGTAGCAA 2182. chr15_VPS18_NM_020857_1.61777
ACCACTTCAAGGAGGCGATCTGCAGCTCACTTAAGGCCTACAACCACCAC
ATCCAGGAGCTGCAGCGGGAGATGGAAGAGGCTACAGCCAGTGCCCAGCG
CATCCGGCGAGACCTGCAGGAGCTGCGGGGCCGCTACGGCACTGTGGAGC
CCCAGGACAAATGTGCCACCTGCGACTTCCCCCTGCTCAACCGCCCTTTT
TACCTCTTCCTCTGTGGCCATATGTTCCATGCTGACTGCCTGCTGCAGGC
TGTGCGACCTGGCCTGCCAGCCTACAAGCAGGCCCGGCTGGAGGAGCTGC
AGAGGAAGCTGGGGGCTGCTCCACCCCCAGCCAAGGGCTCTGCCCGGGCC
AAGGAGGCCGAGGGTGGGGCTGCCACGGCAGGGCCCAGCCGGGAACAGCT
CAAGGCTGACCTGGATGAGTTGGTGGCCGCTGAGTGTGTGTACTGTGGGG
AGCTGATGATCCGCTCTATCGACCGGCCGTT 2183. chr15_INO80_NM_017553_-1.61017
ATGGTGTTCTGAATTGGGGTCCCGGTTAGCAAAAGCCGATTCCGACACTG
GAACTGTAAGAGGATCTTCCAA 2184. chr15_RTF1_NM_015138_1.51037
ATCCCACAACAAGGAACGGCGTTCCAAGCGGGATGAGAAACTAGACAAGA
AATCTCAAGCCATGGAGGAGCTAAAAGCAGAGCGAGAAAAACGAAAGA 2185. chr15_RPAP1_NM_015540_-1.56852
GTCCCCAAAGAGCGGGTAAATAGCTAAGCCACTCTTCACTCCCAGTACAG
ACCTTCAGAAGCCCCAGATATCAGGATGTAATGGTAGGGCTCACTGCTCT
AAAACAGCTCAAACAACCTGCTCCCAGGAAGGCAAGCCTTCTGCTCCTTG
GTCTCCTGCCTACCATTAGGACACAATGTTCTTCGTCTGGCCAGACATCT
GTTGAAAGGCTGGATACAGGACAACGTACCCAT 2186. chr15_TYRO3_NM_006293_-1.75836
CGCGCTGCTGACGGCGGCGACCGCGGCCGGAGGCGGGCGCGGGTCTCGGA
GGCGGTCGCCTCAGCACCGCCCCACGGGCGGCCCCAGCCCCTCCCGCAGC
CCTCCTCCCTCCCGCTCCCTTCCCGCCGCCTCCTCCCCGCCCTCCTCCCT
CCTCGCTCGCGGGCCGGG 2187. chr15_TYRO3_NM_006293_-1.63533
TGTGGTAGTCCTCCCAAGCTGTGCTGGGAAGCCCGGACTGACCAAATCAC

Figure 3-178

CCAATCCCAGTTCTTCCTGCAACCACTCTGTGGCCAGCCTGGCATCAGTT
TAGGCCTTGGCTTGATGGAAGTGGGCCAGTCCTGGTTGTCTGAACCCAGG
CAGCTGGCAGGAGTGGGGTGGTTATGTTTCCATGGTTACCATGGGTGTGG
ATGGCAGTGTGGGGAGGGCAGGTCCAGCTCTGTGGGCCCTACCCTCCTGC
TGAGCTGCCCCTGCTGCTTAAGTGCATGCATTGAGCTGCCTCCAGCCTGG
TGGCCCAGCTATTACCACACTTGGGGTTTAAATATCCAGGTGTGCCCCTC
CAAGTCACAAAGAGATGTCCTTGTAATATTCCCTTTTAGGTGAGGGTTGG
TAAGGGGTTGGTATCTCAGGTCTGAATCTTCACCATCTTTCTGATTCCGC
ACCCTGCCTACGCCAGGAGAAGTTGAGGGGAGCATGCTTCCCTGCAGCTG
ACCGGGTCACACAAAGGCATGCTGGAGTACCCAGCCTATCAGGTGCCCCT
CTTCCAAAGGCAGCGTGCCGAGCCAGCAAGAGGAAGGGGTGCTGTGAGGC
TTGCCCAGGAGCAAGTGAGGCCGGAGAGGAGTTCAGGAACCCTTCTCCAT
ACCCACAATCTGAGCACGCTACCAAATCTCAAAATATCCTAAGACTAACA
AAGGCAGCTGTGTCTGAGCCCAACCCTTCTAAACGGTG 2188. chr15_JMJD7-PLA2G4B_NR_015346_-1.67739
CGTGCGGAGCGAGTTACGAGAATTCCCGGCCGCTGCA 2189. chr15_SPTBN5_NM_016642_-1.51343
TGTGTGTTTCCTGCCGTGGCGGCCCCGCAGCCTCTCACACCGGGCTCCCG
TGAGGTCAAGGAGGGCTATGGAAGCTACTTT 2190. chr15_PLA2G4D_NM_178034_-2.32415
ATTCCCTTGGCTGGTGCTGGTCCT 2191. chr15_CAPN3_NR_027911_-1.70532
ACAAACCCTTGTCCCTTTGCCATGTGGAGGAAAGTGCCTGCCTCTGGTCC
GAGCCGCCTCGGTTCTGAAG 2192. chr15_LRRC57_NM_153260_1.54957
AGAGAGTTGCCCAAAGGTAGACGGCAGCTCTCTAAGGTGATTGTTGTTTA
GGCTTAGCGTCTCTAGTTTTTTCAGATTGCATATCTCATCAGGCA 2193. chr15_CDAN1_NM_138477_-1.96639
TTTATCTCGGAGATGAGGTGGGAGGG 2194. chr15_CDAN1_NM_138477_-2.06309
AGCTGGACTTAGTTCAGGGTCGCTGTCCTTGGCAGTCACCATCCTCCGGG
CAGTGAGGAGCTGAAA 2195. chr15_UBR1_NM_174916_1.70514
TGCATACAGGTAAGAATCTTCAAAAAAGATCGAAAACCTTCAAGGAACTG
CATTCTTAATCTTTCTGTCCATATTGTGGGTTTGCTGATCAGGATATAC 2196. chr15_UBR1_NM_174916_1.55054
ATGGCAGTGGTATGCAACTGGGCCTCTGCGAGCTCACAGTCAAGAGCTCT
TTGTAGGCTGTATATGACGTGGTCATATGAATGGTGTTCA 2197. chr15_ELL3_NM_025165_-1.83761
CCTCGGTGGCCTTGGAAAGCAATCAC 2198. chr15_MFAP1_NM_005926_-2.02478
TTGATGGCAGCGACGGTGATTCCCGAAACTTGA 2199. chr15_DUOX2_NM_014080_1.5551

Figure 3-179

CTTCTTCACGCTCTCTTTGAGTTTCTTTTGTAGCTTCTTGTGTTCTCGGC
CCCGGAAATAGGCCA 2200. chr15_DUOX2_NM_014080_-1.56715
AGTACGGTGCGGTTGTGGAGCGACGGCAGGCCGGCTATGCCCCGCGTGGC
TGCGTTGCTGAGCCGGCGCGGGTTGGGCAGCTGCGGCTCCTCCAGAGCCT
GATACACACCGTCGGCGTAATTGGCTGGTACGCGGCGCTGCAA 2201. chr15_C15orf48_NM_197955_-1.53651
TTGGGAAACTGTGGACCCTACTGTACCTCAAAAG 2202. chr15_C15orf21_NR_022014_-1.54467
TCTGGAAGTGTTAGTTGCAAAGAT 2203. chr15_ATP8B4_NM_024837_-1.50316
AATGTGTCTTTTCCAGCCCTGATGTTGGGGGTGGATTTTTAGCTCGCATA
TTTTTTCCAGATGTGATAAGCTCTCCATAGCCTTCTTGGTGAGCAAAAGC
ATAGCCAGACCTTCTTGAGCTTGACCTGCGGGTCCGAGGCCTTCGGCTAC
TTGGAGGCCTTGCCTTCTTTTGAGCCTTCTGCCACCGGCG 2204. chr15_TMOD2_NM_014548_2.00493
TGGATACCAGTTTACCAAGCAAGGGCCACGAACAAGGGTGGCA 2205. chr15_GNB5_NM_006578_-1.51614
ACACGAAGGTGTTTCCAGTTTCTGAGGGGGCCAGGTCCAAGCAGAGGACG
TCAGCCCCATGTCCGTGGAAGCTCTGCAGCAGCTGCCCGCTCTCCACGTC
CCACAGGGCACATGTGCCATCGCCGCT 2206. chr15_MYO5A_NM_000259_1.55999
TTTGTGTAGAGCTCCGACGCAGCCAT 2207. chr15_ARPP19_NM_006628_-1.65286
TAGCAACAAGGGACGGCTTCCGTTGAGGAAGGTCTTGCGGAGTGGGAATG
TGG 2208. chr15_PIGB_NM_004855_-1.71324
ATACTCATTAACCCACCTGAAAAC 2209. chr15_NEDD4_NM_006154_-1.76332
CCAGGAGCCCGAACACCTCCACCGCGCAAGTTGC 2210. chr15_GCOM1_NM_001018090_-1.96973
TGCTGCGCTCCACGTCCACGGTCACCCTGCTCTCGGGCGGCGC 2211. chr15_TLN2_NM_015059_-2.15536
TGCAGAAGGCCTCCGGGTAGCAACCAACGCAGC 2212. chr15_TPM1_NM_001018005_-1.54027
AGAGTTGGATCGTGCCCAGGAGCGTCTGGCAACAGCTTTGCAGAAGCTG 2213. chr15_ANKDD1A_NM_182703_-1.87358
TGCCCTGCATTCGGCTGCTGGAGGATCCCACCCTGACTGTGTGCAGCTCC
TCCTCAGGGCTGGGAGCACCGTGAATGCCCTCACC 2214. chr15_CILP_NM_003613_1.51834

Figure 3-180

AGGCCCTAGGGTTGGACAAGAAGCCAGTTCTAGGCTCCAGGTTAATCACG
GAGATCACAACCCCCTGGATCTGCTCACTAGGCAAGAACCTCTCACTCCG
GTAGGCCCTCACCTTAACAAAGCACCGCCTGCTTTCAGGAACATCCAGGT
TAAAGAGCCTCCTCTCACGAATCTCCAGGTTGCCCACCAGGAAGGTTCTG
TCTTCTCTTTTGTTCCTCCTTTGATTTTCAAATTTGAAATCACCTTCCTC
CTCCCACAGCCCTGTGTCTGGATTGAGTGACCAGAGTTTCACTGTGGATA
TGTGCTCTGGCATCTTGACCTGGGTCGAGTCAAGGTGGACCTTCACTTTG
CCAGCATTAAGTGGCTCTGAGGTGACCTCATCTCTGAAGTCCACAGAGAA
CATGCCATACGTCCGAAGGGGGAAAGTGTCTCCTTCGTCATTGATGAAGT
TCAGGTCAGTCTGGGCAGCTGTGGCTGTGGAAATATTCCGGGGATCCAGG
AAGGTCACACTGGCCTTCACTTTTCCTATGTAGGGCTCCCCATTCTGCCT
GTAGAAACTCCTGGATGGAATCTCCAGTTCAGCCATGGGGTCTTCACCAA
CCACTTCCCCCAGGGGGATGATGTTGGTCTCCATGGCTTCCAAAGTGATG
GGCTTTTTCCGACGAAGCATCTTGATTTCATGGAACACGGCACTCCCCTT
CTTGTTGAAAGGTAGCACTTTGGTGGTGTTGACAAACTTCTGCAGCCTGT
CCACAAATGTGAGCACCAGCCTCTCAGTGTCCTGGGGGACATGGAGGGTG
AAAGTGCCCTTGTAGCCAGTCATGCTTACACGGCTGTTCCCCATGTACAC
ATGGCCAAAGCGCATGGGCTCCCCATTGTCAGCAGCACTGACACGGCCCC
GCACGATGCTCCGAGTTTCCGTACACCGCTGGCAGCTGCACTCCTTGGCC
ACCTTGGTGGGTAGCGTGTAGCCACTGCACTGGATCTCCCTTTCCTCTGT
CTTGGAGATGCCACAGCAGTTCTGCACAGCATCACGGCACCTGATCCCAT
TATCCTGCTGCCCTGCACAAGTCTTAACAGGGCAGCGTCCCA 2215. chr15_IGDCC3_NM_004884_2.6461
GCGGAGACGCGGCGCGCTGCACAG 2216. chr15_IGDCC4_NM_020962_1.67489
TTTATGGCGTCGTACACCAGAGCCTGCAGCAACAGCGTCTGCCCAGTTCC
AGCAGGGGGCAGCAGGGCCCGGGTCAGAGCCGGCCGGGGGCCTGCCTGGG
GCAGCTCACAGCCTGCCCAGGAACCAGCCCAGCTCAGCCCGCTTGGTTGA
GCCCAG 2217. chr15_RPL4_NM_000968_-2.49299
TGTTCCGGCGCATGGTCTTTGCAT 2218. chr15_LCTL_NM_207338_-1.5048
CGAGGATCACTGAACGTGATCCAGTGCTTCACACGGTCCC 2219. chr15_MAP2K5_NM_145160_-1.5001
GTGAAGCCCTCCAATATGCTAGTAAACACAAGAGGACAGGTTAAGCTGTG
TGATTTTGGAGTTAGCACTCA 2220. chr15_ITGA11_NM_001004439_-2.59387
GAGGATGGGGATGATTACGAATTC 2221. chr15_SPESP1_NM_145658_-1.55538
ACAACCGTTGCTGGGTGTCCCAGGGCCTGAGGCAGGACGGTACTCCGCTG
ACACCTTCCCTTTCGGCCTTGAGGTTCCCAGCCTGGTGGCCCCAGGACGT
TCCGGTCGCATGGCAGAGTGCTACGGACGACGCCT 2222. chr15_TLE3_NM_005078_-2.16688
GGCTTGGTGTGGTGCAGCACCTCC 2223. chr15_PARP6_NM_020214_-1.98349
GTGCAGACATGGTCGGACACAGGGCACACCCAGATGTTCCCATGCTT

Figure 3-181

2224. chr15_HCN4_NM_005477_-1.6158
GTCCAGCGCCACGGTCTCGAAGGCCCTTCGCATCATGGGGTACTCCTCCA
GCACCTCATTGAAGTTGTCCACGCTCAGCGAGTAGAGGCGGCAGTAGGTG
TCGGCCCTCACGCTGGCTGT 2225. chr15_CD276_NM_001024736_-1.70976
CTCAGGCGGATTCTCCGGCGCGGCCCGCCCCGCCCCTCGGACTCCCCGGG
CCGCCCCCGGCCCCCATTCGGGCCGGGCCTCGCTGCGGCGGCGACTGAGC
CAGGCTGGGCCGCGTCCCTGAGTCCCAGAGTCGGCGCGGCGC 2226. chr15_PML_NM_033250_-1.78289
TGGAGCCCATGGAGACCGCCGAGCCACAGTCCTCGCCAG 2227. chr15_CYP11A1_NM_000781_-1.5285
GCAAAGCGGAACAGGTCATCACTGAT 2228. chr15_C15orf17_NM_020447_1.52981
GAGTCTGGGCGGTTCGGCGAGGCCCCCAGCATGCCTTTTCTCCGCAGAAC
GGCCTTGGCCAG 2229. chr15_C15orf39_NM_015492_-1.88585
CCTGTGATGTATGGCAAGCTGCCCCGCTTAGAGACAGACTCCGGGCTCGA
GCACAGCCTGCCCCACTCTGTTGGTAACCAGGATCCCTGCACCTACAAGG
GGTCCTACTTCTCCTGCCCCATGGCAGGTACTCCTAAGGCCGAGTCTGAG
CAGTTG 2230. chr15_C15orf39_NM_015492_1.62297
CCTGCTGACCAACTGCCTGTTCTACCGCTCGCCAGCAGAAGGCCCTGAGA
AGATGCAGGACTCCAGCCCTGTTGAGCTCCTGCCCTTCAGTCCCCAGGCT
CACTCCTACCCAGGCCCACCACTGGCAGCACCCAAACCTGTCTACCGCAA
CCCTCTGTGCTATGGGCTCTCAACTTGTCT 2231. chr15_CSPG4_NM_001897_-2.01214
CTGAGGGTCTGACTGCTGAGTGGC 2232. chr15_ISL2_NM_145805_-1.66435
GCATCAAGTGCGCCAAGTGCCAGGTG 2233. chr15_RCN2_NM_002902_-1.76833
GGAGCTGCACTACCCGCTGGGCGAGCGCCG 2234. chr15_TSPAN3_NM_005724_1.51879
AGCAGCCAATTAGCCCAATGATGAAAAGCAGGGCTCCTACAGCTATGATC
ACTACAGCAGGGATGAGCGTGTACACATCTTCAAAGAAGTGGTCATAGTC
ATCATAAGTGATGAAGACATAGGCTCCCA 2235. chr15_ADAMTS7_NM_014272_1.64148
GTGGAGACATGATGAAAGGTCGTTTCCCAACGGGCTCACAGTCATTGCCG
CTTCCGTCA 2236. chr15_RASGRF1_BC040275_-1.81052
TACCTGGGAGTGTTAGACCTCAGCCCAGTACTTTGCCCACTTGTGGATGC
CCAGTGGCCAGCCCACGGGTCTTCCTGCCCTAGCCCCAATCC

Figure 3-182

2237. chr15_ARNT2_NM_014862_1.52982
AGTGGACAAAGTAGCGGGCAGTTCCAAGGGCGGCCCTCGGAAGTCTGGTC
GCA 2238. chr15_KIAA1199_NM_018689_1.65752
GGCGTCAGTGACTGCACAGCCACAGCTTACCCCAAGTTCACCGAGAGGGC
TGTCGTAGACGTGCCGATGCCCAAGAAGCTCTTTGGTTCTCAGC 2239. chr15_AKAP13_NM_006738_1.54681
AATGGAGAGGGTTAAAAACATGCAAACTGCCACTTTCAACCTTTGCCAGT
ATTCCCTCTACCCCCGTGAGAGCTATCTGGGGGGAAG 2240. chr15_HAPLN3_NM_178232_1.56956
CAATGACCTCACAGCGGTAACGCCCATAGTCCTCCAGCCGCAGATCCTGG
ATCTCCAGCGAGACGTCATGCTCTTTGTCCTGCCGCAGGTGCACGCGGCC
TTGGTAGTCCCCAAAGGAGCGGTGCCTCAGCCCGATGGCCACCAGCACGT
CCTTCTCTGGGGCCCCGTTCTCCGACAGCTTCCACCATTTGACACGCACA
CGCCGCGGGGAGACCAGGGCCGGCTCGTAGCGGTAGCGGCAGGGCAGGAT
CACACTGGCCCCTTGGTAGGTGAACAGGGTCTCCTCGGGTGTCTCCA 2241. chr15_POLG_NM_002693_-1.58315
TGGATGTCCAATGGGTTGTGCCGCAGCTGCC 2242. chr15_KIF7_NM_198525_-1.75381
GCTCTGGGCCGCAGCGACCCTCCTGCGGAACTCCTGGAGCCGAGACCGCT
CGCCAGCATCCTGGAGCTCCTTGCCCTCGAGCTCCCGCAGCTGCCTCTGG
CCTTCACTCAGCTCGGCCCGCACCTGCTCTGCCTCCTGCTCCAGCTCCCG
GATACGCTGGCTGTGCTGG 2243. chr15_IQGAP1_NM_003870_1.6869
AGCTGCAGTCTGGAGTGGATGCTGC 2244. chr15_CRTC3_NM_022769_-1.94296
TGGACACCACCGACCACCACTTTGGCAGT 2245. chr15_MAN2A2_NM_006122_1.60817
GGCGGAGACCGCACTCATCTTACACCGCAAGGGTTTTGACTGCGGCCTGG
AGGCCAAGAACTTGGGCTTCAACTGCACCACAAGCCAA 2246. chr15_VPS33B_NM_018668_-1.78117
TCTGCCCAGGAACCGGAGGGCTGAGATCTCAGAGAATGTACAACCACCCA
AGA 2247. chr15_LYSMD4_NM_152449_-1.84191
ACGGGGCCAGCCTTCGCGTCCGAGCTCAGGGG 2248. chr15_ADAMTS17_NM_139057_1.61703
TGTCTGCCCCACACTCGGTGCCATCCAGGGGAGGGTCCAGCTTGGTCTTG
CAGGATGTGTCTCCTTCTACCAGGCACCACAGTCCAG 2249. chr15_LRRK1_NM_024652_1.51147
ACACGGGCGGCAAGCCGTCCACGCGGGGCGGTGACCCTGCAGCGCGGTCC
CGCAGGACGGAAGGCATCCGCGCCCGCGTACAGGCGGGGAGACCGCGGCGG
CGCCCGGGACCTGCTGGAGGAGGCCTGCGACCAGTGCGCGTCCCAGCTGG
AAAA

Figure 3-183

2250. chr15_PCSK6_NM_138320_1.547
TATCCCGCTGCTGCACGGTGTCTGCCCACAGCAGGGACCCAACAAATATG
CATCCAGTGAACAAAGGGACGAAGGCCCCTCAGCAGCTCTGTAAATGGGC
TCCTGTCCACAGTGGGGTGATGCAACATGCCCTC 2251. chr15_TM2D3_NM_078474_-1.56399
TTAGAGCCAGAGCCGTAGACCACTTATAGCCTCCAGTCCAATTGCAATAT
AGCATTTTGG 2252. chr16_SNRNP25_NM_024571_1.52135
AAGTCAACTCCCAAATAGCCCTAGAATACGGCCAGGCAATGACGGTCCGA
GTGTGCAAGATG 2253. chr16_ITFG3_NM_032039_1.51321
TAGCCTAGCCCTCCCGAGCCTCCCTGGGGGTCCACTGTCCGCCAGCCTGC
CGACCGCAGACCACCGCTCAGCCTTCTTCTTCTGGGGCCTCCACGAGCTG
GGGA 2254. chr16_RGS11_NM_183337_-1.52714
GGGCGTCTCGTCTGGCCGGAGCATGAGGCTACGGGGGTCGCGCAGCGGGT
AGATGTAGCCATGCTGCACCAGGAC 2255. chr16_RAB11FIP3_NM_014700_-1.62354
CAGTGAGGCGGAGCTGTCCCCAGAGACCCTATGCAACGGGCAGCTGGGCT
GCAGTGACCCCGCTTTCCTCACGCCCAG 2256. chr16_FAM195A_AK054811_1.66976
CCTGGCTCAGCCCGACTGCCCTCCT 2257. chr16_WDR90_NM_145294_-1.64131
GCGGGCAGGGCAGTGTGCGGCTCTGGCGGCTGCGTGGCGGGGTGCTGCGT
TCCTGCCCCGTGGACTTAGGGGAGCACCACGCGCTGCAGTTCACCG 2258. chr16_RHOT2_NM_138769_1.65158
ACAGATGGTCTGCTGGCCACATCGCTGGACGCCACCTGTGACGTTGCCTG
CTTGATGTTTGAT 2259. chr16_RHOT2_NM_138769_2.04405
CTCAAGTTTGGAGCCGTTTCCGTGGTTGTAGCAG 2260. chr16_CCDC78_NM_001031737_-1.69963
CTCCTGATGCTCCAGCGCCCACTTCACTTCCCCCTG 2261. chr16_HAGHL_NM_207112_-2.73131
CTGCGGCCACGAGCACACGCTTAG 2262. chr16_NARFL_NM_022493_-1.9644
TGAGACGGCCCGATGAAGTCATCCAGGTCCGTCAGCTGCAGCGCCCCGCT
GAAGGGCGACGCCAT 2263. chr16_MSLN_NM_005823_-1.82199
CTGCGCCCCTGGACGGAGTCCTGGCCAACCCACCTAACATT 2264. chr16_MSLN_NM_005823_1.50613

Figure 3-184

ACCCCGAGTCTGTGATCCAGCACCTGGGCTACCTCTTCCTCAAGATGAGC
CCTGAGGACATTCGCAAGTGGAATGTGACGTCCCTGGAGACCC 2265. chr16_CACNA1H_NM_021098_-1.53782
GGGGAACGTGAGTCCCTGCTGTCTGGCGAGGGCAAGGGCAGCACCGACGA
CGAAGCTGAGGACGGCAGGGCCGCGCCCGGGCCCCGTGCCACCCCACTGC
GGCGGGCCGAGTCCCTGGACCCACGGCCCCTGCGGCCGGCCGCCCTCCCG
CCTACCAAGTGCCGCGATCGCGACGGGCAGGTGGTGGCCCTGCCCAGCGA
CTTCTTCCTGCGCATCGACAGCCACCGTGAGGATGCAGCCGAGCTTGACG
ACGACTC 2266. chr16_UNKL_NM_001037125_-1.56896
GTTGCGCCGCCTGTCCCGGCTATTGTGGTAGTGTGGGCACGCATAGCCCT
GGCGGCACAGGCGTGGCGGCTTCGGGCACTGCTCCGTCTTGTAGCTGCCC
AG 2267. chr16_CLCN7_NM_001287_-1.86318
GTGTGATTGATCCGCCGCTCCTCCTCCAGGAACAGCTGGTTCTCACTGTT
GTCATAGTCCAAG 2268. chr16_CRAMP1L_NM_020825_2.07158
TGCTCCGCACCGATGCAGGAGAAG 2269. chr16_SPSB3_NM_080861_1.58479
CCAGCCCAGCTTGTTGTGTAGCACCTGCTTGAGGCCCGGCGGCAGCGGCA
GACCCTCCAGCGTGTCTCCCGAGTCTGGCCGCAGCTGGCGCAGGCGGTGG
CAGCACAGGTACTGGAGGGAAGTGGCGCTGGCACAGGAGCGGGTGACCTT
CATGCTGCTCCGGGCCGCCGTGGAGCACACCATCGGGTAGA 2270. chr16_SPSB3_NM_080861_-1.69691
TGCCCATCAGAGTCGTAGCCCCAGTTAGTGGAGCCTG 2271. chr16_HAGH_NM_005326_1.55933
TACATGTAGTTGTCGGTCAGGGCAGGCAG 2272. chr16_HAGH_NM_005326_-1.66576
GGACTGCAAAACACCGGCGTCGGCGCGTCGCAGCCAATCAGCGCCCGCCT
CGCGCTGCCCTCAGCCAATCAGCGTCCACCTCGCACCGTCCGCCAACCAA
TCAACGCGCTCGCGCTCAACTTGTTTTGTCCGCGAGCCCCGACTGCCACG
GGCCGGGAGACGGGCCTGGGAGCGGCGGCGGCGGCCCGAGAGCTGCGCCG
GGAGAGCTGTGCCGCGAGCCTCCGCCTCTTTTTTGGCACCGCACAGTGGA
TCCCTGGAGGCCGAGCGCCACGCCGCCCGGGTACCCGGCAGATCGCGAGG
TGGAAC 2273. chr16_RPL3L_NM_005061_1.7689
TTTGCCGACCCTGCAACTTGATGGATCTGCTGGCACCAACCAGATTGATA
AACTGGCTCATCTGATCTTGTGGCCACCACCCAGGAGCTGACTCAGCGCA
AGAAGACAGCTGACTCCCTGTGATTTCCTCCCTGACCAATCGGCTCTCCT
GGCTCACTGGCTCTCCCCACCCGCCAAGTTATCCTTAAAAACTCTGCTCC
CCGGCACTCCAGCAGCCTGGGCGACAAGATCAAGACTCTCTCAAAAAAAA
AAAAAAAAAAAACCTCTGCTCCGCAAATGCTCAAAGAGATCGATTTGAGT
AATAATAAAACATAAAACTCCGGTCTCCCGCACAGCCAGCTCTGTGTGAA
TTACTCTTTCTCTATTGCAATTCCCCTGTCTTAATGAATCGGCTTTGTCT
AGGCAGCAGGCAAGGTGAACCCCTTGGGCGGTTACACAGCGCTCTGAGAC
CTCGCAGGAAGAGTCGCCTCCGGCCTTTGTTA

Figure 3-185

2274. chr16_TBL3_NM_006453_-1.65837
CCTGGATGTGTTCCGGAAGGGGTGGCTCTTTGC 2275. chr16_TRAF7_NM_032271_-1.93549
ACAACATGATCTGCACGCAGACCCTGCTGCGTCACCAGGGCAGTGTCACC
GCGCTGGCTGTGTCCCGGGGCCGACTCTTCTCAGGGGCTGT 2276. chr16_CASKIN1_NM_020764_-1.50433
GGCGGGGCCCTCATCCAGGAGGTAC 2277. chr16_CASKIN1_NM_020764_-1.74792
GTCCCCCGGGCCGGACTCAGAGACGGACTT 2278. chr16_DCI_NM_001919_-1.50151
GCGCGGAGCAGAACGCGCGCCGGGACTCGCACAGAAGCCACCAGCG 2279. chr16_---_---_-1.50489
GCTCTCTGCCAGCCCGCACAGCAGTGGAAGGCAGGCAGGGCTGAATAAAG
GGTCTG 2280. chr16_---_---_-2.18269
GTGTGGGAGGTTGATTGTAAAGAAAA 2281. chr16_RNPS1_NM_006711_-1.544
GTGTCTGCGCCGAGAAGGACTTGGAGA 2282. chr16_---_---_-1.52339
CTGACCCAGGCTAGGTTGATTTTTTC 2283. chr16_CCNF_NM_001761_1.52816
AATTTTCCCAGATAGGCTAGCCAGAAAAAACTTCAAGTCCTCTGTAACAT
CTGAGGTGACCAAGAGGCAGAAGAGCAGAGCAGTCGGGGGCCGTGTCCTG
GCTGATCCCAACTGCAGCTCTGCTGTGGGGGCCCGTGGGAGGGAGGCAGA
CCCCTGGGCTTTCCTGCTGGCCACGGAGACTCTGCTCCTGCATGGAAAGG
GAGCCTGGGAGCCAGCAGCCCACGCCTGGGGAGCCTGCCTGGGGCCATGT
GACCATGGCCTCTCCCTGGGAACGGGCTGACCACAACACACCCTGCTGCC
ATCCACTTCTGTTTACTCTGCAAATGTAAGAAAGAACCACTTGGCCAGAA
GTGTCCCCCAGATGCTTTTTTTTTTTTTTTTTGGAGACAGTTTTGCTCT
TGTCTCCCCGGCTGGAGTGCAGTGGCATGATCTCAACTCTCAACTCACTG
TAACCTCCGCCTCCCGGATACTCCTGCCTCAGCCTCCTGGGTAGCTGGGA
TTACAAGCACCCAACCACGCCCAGCTAATTTTTGTATTTTCGGTAGAGAC
GGGATTTCACCATGTTGGCCAGGCTAGTCTCGAACTCATGACCTCAAGTG
ATCCGCCCACTTCGGTCTCCCAAAGTGCTGGGATTACAGGCATGAGCCAC
GGCGCCTGGCCCCCAAATGCTCTTGAACCGGAAACCCAGGGATGGGAGAT
GCTCACTGAGCTGCTGCTTTTATGTGTGCTGGTGCTATGTGTGTTCATGT
CCGCGGCAGCTGTCTTTTTGCTACTATAAGGGAATTCTGGCCACCCTGGG
TGGGGTGTGGTCGGGGTGAGAACCCAAGCGTTGGAACTGTAGACCCGTC 2284. chr16_PRSS27_NM_031948_2.31448
TGTTGCTGCCTTGGCCCTCTGAGAC 2285. chr16_SRRM2_NM_016333_-2.30865
TCCCCTTCCCCTGCTAAGCCTGGCC

Figure 3-186

2286. chr16_---_---_-1.64523
ACTGCACGGCGCGGGCGATACCGTTGCAGGGGTTGCATGCCACGGTGCCC
TCGGCGCCCGGGGCCCGGCACGAGGTCTAAACATCGC 2287. chr16_PRSS22_NM_022119_-1.68138
AGGTATCCTGGCCGCATTGAGGATGG 2288. chr16_TNFRSF12A_NM_016639_1.55107
CCTGGAGCGCGGACCTGGACAAGTGCATGGACTGCGCGTCTTGCAGGGCG
CGACCGCACAGCGACTTCTGCCTGGG 2289. chr16_ZNF263_NM_005741_1.68647
CATGAGTGCGGAGACAGCTTCTCTCACAGCTCCAATCGGATTCGCCACCT
GAGAACGCATACGGGAGAGAGACCCTATAAATGTTCTGAATGTGGAGAAA
GCTTCTCTCGGAGTTCCCGTC 2290. chr16_NLRC3_NM_178844_2.56084
GGGCCTTGGCACCTCCATCACCAATACTATTACTGG 2291. chr16_TRAP1_NM_016292_1.56727
CCAGGCCAGGCTCGCTTGCGCGCAGCTGATTCAGCTTC 2292. chr16_TRAP1_NM_016292_-1.57838
GGGTTGATCTCCAGCGTGGGCTGCAGGAGCTGTGCGCGCTCCTCCTGGGT
CTTGGCCAGCTGCTGCATGCGCAGGAAGTGGCGGGCAGCCCCCATCTCCA
GCACGGTGACCATGGCAGGGTGGGTGTCCAGTCGGAGGGTCAC 2293. chr16_CREBBP_NM_004380_-1.90778
GGTGAGACGTGGTGTGGCGAAGGCTGGGGCTGTATCCGTGGTGACGGGCT
GGAATGT 2294. chr16_CREBBP_NM_004380_1.62939
CTGTGCCGTTACTGCTACTCTCTT 2295. chr16_ADCY9_NM_001116_-1.58738
AAGCAGGCTTCATCCCGGAAATGGTAGCCAAAGGTCTCGAAAAGGACAGA
GTAGGCCACCCCCAGACACAAACTCAGGTACAAAGGTAAGTGCATGACGG
TATAGAGCAAAAAGAGCACTTCGATGCACATGGAGAAGCTCCCCACTTGA
GATAAGCAAGTATCTGTGGGCCGGGCTGTGGCCGTAAGGTTGGAGCTGTC
GCCGCGTCCTGAGACAGGCGTCAAGACCTGGAACTGCGCAGCCAGGGTCA
GGGCGAACACCAGCAGGGTGAGAGCCAGCGAGGTCCACGCGTAATGCCGG
GCGTACAGCTTGGTGAAGGTAAACAGAAAGAAGCCCACACACACCAGGAG
GAAGCACAGCGCGGGGGCGACCATGACGATCAGTCTGGATCTCATGTGGA
CCGCAAAATAGATGCTCCACAGAAGGCAGGCGAAGCCGATGTAGAAGAGC
GCATACCGGAACCGGCGCTGGGTCTGCGGGAAGCAGCGCTCCAGGCAGGC
CTCCTCCAGGTTCACCGAGTCGAACTTGGGGTCCCACCAGCGGCTGGAGG
CCCTCTCGAACAGCTGGGGCAGCTTCTTCTGCCTGCGCAGCCGGCCTCCG
CCGCCCACTCGCCGGGGGACGCCCCCGGAGTCCCCAGAGCTGCTGCAGCT
AGAGGAGATGCTGTATTTGCAGTGCTTGGGGTGGCTGTTGGAGGACAGCT
GCTTGGGGTTGATCTTGACGCGCACGCTGTT 2296. chr16_ADCY9_NM_001116_-1.60522
GGCTCCGGGACCGCTTTGCTCGCTCGCCTTCCGCGCCTCTCGCCCCGAGG
GTGGCCTCCGCGCCGCGCGGCTTCTCCTCCTCGCGCGCTCGCCTCCTCCA
GCTGCGGCTCCGGAGGGAAGTTCAGACCTTGAGCGCTCCCAGCCCCGCGA

Figure 3-187

GCCGCCTGCGCACAAACAACTCCGCTGGCGGCGCGGAGCCCTCCATCCTG
CAGGAGCCGCGCTCCGATGCGTCAAA 2297. chr16_CORO7_NM_024535_-1.66064
CCAGGGCGCTGGAGAAGAACCGCGTGTCCCACAGCTTCACTTCGCGCTCA
CGCAT 2298. chr16_DNAJA3_NM_005147_-1.53488
TCTTGCAGGGCTAAAACTCTAATTTGGAATTGAATATTGTGGATATCTTA
GTTAAAGGCCATGCTTACAGCTTAGAAATGAAGCCTTAAGCTGCATCAAG
TTACGAAGTGATTAATTTCCTTCTCAGCAAACCTCCGGGAGGTTCCAGAA
TGAGTTCTTCCTGACAGGTTGTCTTCACTGGGAGCGTGGGGCCCCCAGGC
CCCACCAGCACCGTCCTCCCCTAATGAGGGGCCCTGCCGAGGCATCAGCT
GCTCTGCTCAGTTAGTTTTTATTCCCGGGGTACCAAGCAGCTGCACAGTC
GGTGCCTGGGAGGCACGTAGAGGCCCAGAGAGTCCCTGGGGGTTCTGCTC
TGACCGTGTGGGTGGTGATCCTTGTCAGGATGTACAGTCCTTGCTCCCAC
CCCATCCGGGATGGCCGCCTGTCCCTGACTATTGAGTCCTGTTGTTGTAA
GCCAGGCATGGAGGGCTCCTGCCCTTCTGCTGAGCCACAGCCCATTGCAG
CACTGTGCTGGCCAGACTTCAGCTGCCTTGGGAACTGAAGCCCTGCCACT
GTTGCTAGTCA 2299. chr16_NMRAL1_ENST00000404295_-1.54004
GCCTGGGCGGGACAAGTTCCAGGAGCCCGGGACCCCGATTCTGCGGCCGA
GTCCACTGCAGAGGCGGGGATGGAGCTGCGCGCTAGGCGCCAACTC 2300. chr16_MGRN1_NM_015246_1.53425
GGCTCCGAGCATGAGGTCCGCCTCCTGGGCGAGACCCAGCAGTGGACAGC
ATGGTCCTCACACCCAGCTCCCTGCACACCCAGGCCAGCCACCCCTCCCG
CTCGTGCACAGGCACGCAGATGCGCTCACACGTACACACACACAAATGCA
CGCCCACTTGCACATGCTCACGCACATGTTCACACATGCACACTCACGCT
CACACATGCTGTCACGCATACACACACGCACATACTCCTGCACATGTTCC
CATGCATGTGTGTGCACTCGGACCGAGCATC 2301. chr16_ROGDI_NM_024589_1.56702
CAGAAGGGTCTGTAGCTCCAGTAGCTGGAGAACACGGAGAT 2302. chr16_SEC14L5_NM_014692_-1.85763
AGGGTGTTCAAGGCGGGACACACCAGGCTAGAGATCCGCGATCGGGCC 2303. chr16_NAGPA_NM_016256_-1.7757
GTTGGACCCGGTCCATCCGGCATCAC 2304. chr16_C16orf72_NM_014117_-1.73622
AGGACTTTCTCTCTGGGTCCCCTTCCAAAACGCAGCCACCGCCGTCACCA
ATCTCTACAA 2305. chr16_CIITA_NM_000246_-1.51602
TGACCGCGTTCTGCTCATCCTAGACGGCTTCGAGGAGCTGGAAGCGCAAG
ATGGCTTCCTGCACAGCACGTGCGGACCGGCACCGGCGGAGCCCTGCTCC
CTCCGGGGGCTGCTGGCCGGCCTTTTCCAGAAGAAGCTGCTCCGAGGTTG
CACCCTCCTCCTCACAGCCCGGCCCCGGGGCCGCCTGGTCCAGAGCCTGA
GCAAGGCCGACGCCCTATTTGAGCTGTCCGGCTTCTCCATGGAGCAGGCC
CAGGCATACGTGATGCGCTACTTTGAGAGCTCAGGGATGACAGAGCACCA
AGACAGAGCCCTGACGCTCCTCCGGGACCGGCCACTTCTTCTCAGTCACA
GCCACAGCCCTACTTTGTGCCGGGCAGTGTGCCAGCTCTCAGAGGCCCTG

Figure 3-188

CTGGAGCTTGGGGAGGACGCCAAGCTGCCCTCCACGCTCACGGGACTCTA
TGTCGGCCTGCTGGGCCGTGCAGCCCTCGACAGCCCCCCCGGGGCCCTGG
CAGAGCTGGCCAAGCTGGCCTGGGAGCTGGGCCGCAGACATCAAAGTACC
CTACAGGAGGACCAGTTCCCATCCGCAGACGTGAGGACCTGGGCGATGGC
CAAAGGCTTAGTCCAACACCCACCGCGGGCCGCAGAGTCCGAGCTGGCCT
TCCCCAGCTTCCTCCTGCAATGCTTCCTGGGGGCCCTGTGGCTGGCTCTG
AGTGGCGAAATCAAGGACAAGGAGCTCCCGCAGTACCTAGCATTG 2306. chr16_TXNDC11_NM_015914_1.53969
TGCTCCCAGTCGCCGGCTTTATACCGCCGCCGCCGCCTCGGGCCCGAAGG
CCCGGCCCGGCCCGTTGCTCCCCAATCCCGCAGCTCGCCGCACCCGCTAA
CCCGGACGCTCCA 2307. chr16_RSL1D1_NM_015659_-1.57037
GGACTTGCAATGCGTCAAGAGAGCGTCCACTGCCTTTCTAAC 2308. chr16_CPPED1_NM_018340_-1.9323
GAACTCCTCGACGGTCTCGGCCGTGGGGGTGTTGCCAATGTCATGGTTGC
CGCTGACAAGGACCAGTGGGATGGCCCTGTCCACTGCCCTAAGCACTCGC
TTCAGGTCCTCCGT 2309. chr16_MYH11_NM_002474_1.63116
CCTCCTCGCTGAAACCCATGATTGCCATGGCCTCCACGGTTTCCTGGAAC
ATCTCATCATCCTGGGCTGCTGGGATGGGCACAAAGCCATTGGAGAGGAA
GGTGTAGTTGTTGAAGCCCTCC 2310. chr16_ABCC1_NM_004996_-1.85201
GGCCGTGTACTCCAACGCTGACATTTACCTCTTCGATGATCCCCTCTCAG
CAGTGG 2311. chr16_ABCC1_NM_004996_1.56126
TGGCATGCTGGTGACGGACAGTGCAGGGAA 2312. chr16_ABCC6_NM_001171_1.60354
AGTCCATCACGGAGCGCAGGCGGTGGGCAATGAGCAGCACAGTGCACTGT
GCAAACCAGCTCCCGAGCATGGCCTGCATCTGCAGCTCCGTGCCAGGGTC
CACGGCAGCAGTAGCCTCGTCCAGGATGAGGATCTGGGTCTTCCGGAGAA
GGGCACGTGCCA 2313. chr16_ABCC6_NM_001171_-1.75416
ACTGCAGGGTCGTCCGCCCACAGGCTCAGCCAGTAGCCCCGGCAGAAGGA
GGCCACTTGCTGGCAGAGGAAGAGGAAGAGTGCGTAGAGGCAGAGGGGGG
TGCCCACGGCACGCAGGTAGGCCAGGT 2314. chr16_XYLT1_NM_022166_-2.17594
CTCGAGGGGGCAGAACCGAGTCAC 2315. chr16_TMC5_NM_001105248_1.53422
AAATATCAATCATTGGCATTCTTTGTTACTATTGGCTCAACACCGTGGCC
CT 2316. chr16_DNAH3_NM_017539_1.56661
GACACTGATGGTGGCCGGTTGGTAGACCTTCAGCAGATCTTTCA 2317. chr16_VWA3A_NM_173615_-1.87723

Figure 3-189

GCAGAACCAAAGGTCACTCTTTCC 2318. chr16_POLR3E_NM_018119_-1.75207
CTGCTTCCCCGGATGAGCAGAAGGTGTTT 2319. chr16_CDR2_NM_001802_1.5106
GCAAAGCTGGGTGCCGGTTTCTCCTGGTCACACTTTCCCGGGCTCCTTCT
CCCTTGGCCAGATGACTTCAGCTCCTCCACTTGGCTCTGGAGGTGATCAA
TGTTGGTTTGCAGGCATTCAATCGTTTCAGTCAGG 2320. chr16_ERN2_NM_033266_-1.71109
GAAGAACTGGAGTTGCTTGGCTCT 2321. chr16_ERN2_NM_033266_-2.19261
TGCGGCAGGGAGAGGCATGAACCAGC 2322. chr16_SLC5A11_NM_052944_-2.48992
TGAGCTGGTTCACAGAGCCACCCT 2323. chr16_XPO6_NM_015171_1.82949
AAGGTTTGGCCACGGAAGCAGCAAGATGTTAGAGAGGGCTCGGCACACCA
ACACCTGG 2324. chr16_TAOK2_NM_004783_-1.77626
GTGCGGTTCTTACAGAAGCTCCGGCATCCCAACACCATTCAGTACCGGGG
CTGTTACCTGAGG 2325. chr16_GDPD3_NM_024307_-1.59483
ATGAGCTCTTCGTTCTTCCCTTTGATCTCTACGCTCATGGGTGTCCTTGG
AAACCTCTGGAACAGGTCCTCCAGACGAACCATGC 2326. chr16_ITGAL_NM_002209_-1.62746
CACCTCTATGGCAGCAACGCCTCCCTGGCCCA 2327. chr16_RNF40_NM_014771_-1.72826
CATCTCACGGCTGCGGCGCAAGCTGGAAAAGCAGAGGAAGGTGGAGGTCT
ACGCAGATGCCGACGAAATCCTCCAGGAGG 2328. chr16_ITGAM_NM_001145808_-1.61529
CAGCGCTCACAGCGATCCTGGCGCCTGGCCTGTGAGTCTGCCTCCTCCAC
CGAAGTGTCTGGGGCCTTGAAGAGCACCAGCTGCAGCATAAACCACCCCA
TCTTC 2329. chr16_ITGAM_NM_001145808_1.73246
TCTCGAGTACGTGCCACACCAAGGAGCGCTTGCCCTCTCACTCCGACTTT
CTGGCTGAGCTTCGG 2330. chr16_ITGAX_NM_000887_-1.96552
TTAAATGACATTGCATCGAAGCCCTCCCAGGAACACATATTTA 2331. chr16_ITGAX_NM_000887_1.65622
ACTGAGCGGGGGTCAAGACCTCACCCAGGATGGACTG 2332. chr16_ZNF843_NM_001136509_1.55789
TGCGGAAGGAAAGATTTCAGATCCC

Figure 3-190

2333. chr16_ARMC5_NM_024742_1.55536
TCCCAGCCTGACAAGCTTTCCACTCACAG 2334. chr16_SLC5A2_NM_003041_-1.94986
CTGCGCGGACTCATGCTGGCGGTCATGCTGGCCGCGCTCATGTCCTCGCT
GGCCTCCATCTTCAACAGCAGCAGCACGCTCTTCACCATGGACATCTACA
CGCGCCTGCGGCCACGCGCCGGCGACCGCGAGCTGCT 2335. chr16_GPT2_NM_133443_-1.5723
TGGAGTCCATGAACCCGCAGGTGAAGGCGGTGGAGTACGCCGTGCGGGGA
CCCATCGTGCTCAAGGCCGGCGAGATCGAGCTCGA 2336. chr16_ABCC11_NM_032583_1.58133
GGCAGAAGTTCCAGGTCCCGATTCAGGGAGCA 2337. chr16_ADCY7_NM_001114_-1.69374
AGCGGGACCCCTACCTCAAGGAGATGAACATCCGCACCTACCTGGTCATC
GACCC 2338. chr16_SALL1_NM_002968_1.60971
TCGGCACAGCACCGGCCACAGACGTGGGCATCCTTGCTCTTAGTAGGGCG
ACTCGGTTGACC 2339. chr16_RBL2_NM_005611_1.76693
GCGCTTCGCCGTTTGAATGGCTGCGGGCCC 2340. chr16_OGFOD1_NM_018233_1.56179
AAGGGCGCCGGATTGCCTTCATCCTGTACCTGGTTCCTCCCTGGGACAGG
AGCATGGGTGGTACCCTGGACCTGTACAGCA 2341. chr16_NLRC5_NM_032206_1.69645
TTGTCTCAGGTTAACCTCTGTGAGGACGATGATGCCAGTTCCCTGCTGCT
GC 2342. chr16_GPR56_NM_005682_1.53355
GGTGACTTCCAAGAGTGACTCCGTCGGAGGAAA 2343. chr16_GPR56_NM_005682_1.77118
GAGGGTCTGGCACATCCTTAATCCTGTGCCCCTGCCTGGGACAGAAATGT
GGCTCCAGTTGCTCTGTCTCTCGTGGTCACCCTGAGGGCACTCTGCATCC
TCTGTCATTTTAACCTCAGGTGGCACCCAGGGCGAATGGGGCCCAGGGCA
GACCTTCAGGGCCAGAGCCCTGGCGGAGGAGAGGCCCCTTTGCCAGGAGCA
CAGCAGCAGCTCGCCTACCTCTGAGCCCAGGCCCCCTCCCTCCCTCAGCC
CCCCAGTCCTCCCTCCATCTTCCCTGGGGTTCTCCTCCTCTCCCAGGGCC
TCCTTGCTCCTTCGTTCACAGCTGGGGGTCCCCGATTCCAATGCTGTTTT
TTGGGGAGTGGTTTCCAGGAGCTGCCTGGTGTCTGCTGTAAATGTTTGTC
TACTGCACAAGCCTCGGCCTGCCCCTGAGCCAGGCTCGGTACCGATGCGT
GGGCTGGGCTAGGTCCCTCTGTCCATCTGGGCCTTTGTATGAGCTGCATT
GCCCTTGCTCACCCTGACCAAGCACACGCCTCAGAGGGGCCCTCAGCCTC
TCCTGAAGCCCTCTTGTGGCAAGAACTGTGGACCATGCCAGTCCCGTCTG
GTTTCCATCCCACCACTCCAAGGACTGAGACTGACCTCCTCTGGTGACAC
TGGCCTAGGGCCTGACACTCTCCTAAGAGGTTCTCTCCAAGCCCCCAAAT
AGCTCCAGGCGCCCTCGGCCGCCCATCATGGTTAATTCTGTCCAACAAAC
ACACACGGGTAGATTGCTGGCCTGTTGTAGGTGGTAGGGACACAGATGAC

Figure 3-191

CGACCTGGTCACTCCTCCTGCCAACATTCAGTCTGGTATGTGAGGCGTGC
GTGAAGCAAGAACTCCTGGAGCTACAGGGACAGGGAGCCATCATTCCTGC
CTGGGAATCCTGGAAGACTTCCTGCAGGAGTCAGCGTTCAATCTT 2344. chr16_GPR97_NM_170776_-1.5834
GACATGGGGGTTGGCCATCTTCACCCCGTTGGGCCTCTCCACCGTCTACA
TCTTTGCACTTTTCAACTCCTTGCAAG 2345. chr16_KIFC3_NM_005550_1.78194
GCAGCAGTGGGAAGCCGCGCACCTGCCGCTTGAGCCCATTGTAGTCGTTG
GTGAGGGTCCGCAGTGCCGGCTGCA 2346. chr16_CNGB1_NM_001297_-1.52488
AGTGCCAGGTGTACTCGTACCAGGTCTTGACGCGGTTCTGCACGGACTTG
GGGATCTTGTAGAAATTCATGTACTTCACCGTGCTGTCCATGCAGCTGCG
GTAGTAGGTCTGTCC 2347. chr16_CNGB1_NM_001297_-1.51536
CAGAGGTGACGTCAGGGTCAATGAGTTTCTCCTTCACTTTCTCTGTCCGC
TCCTTGAAGAGCTTCACCAGCTCCTGGAGCCGGTCGTTGATGATGGCGCT
ATTTGTGCTGGCCGT 2348. chr16_MMP15_NM_002428_-1.51028
ACTGGCTGCGGCTTTATGGCTACCTGCCTCAGCCCAGCCGCCATATGTCC
ACCATGCGTTCCGCCCAGATCTTGGCCTCGGCCCTTGCAGAGATGCAGCG
CTTCTACGGGATCCCAGTCACCGGTGTGCTCGACGAAGAGAC 2349. chr16_CCDC113_NM_014157_-1.59106
AAATATTACGCTAAACTGGAGCCCAGGGATCAGCGACCTCCACGATTATC
AGAA 2350. chr16_PRSS54_NM_001080492_1.6111
TCCCCAGAGAGACCCGCCGCGGACACCATGGGCAG 2351. chr16_PRSS54_NM_001080492_-1.52704
AATGGTCCTCAGAGTTCGTCCATGAACTGTTCCTGCTCAAGGAGAAATGA
ACTCAGGCTGGCCTGACACAGTAGAGTTCA 2352. chr16_SETD6_NM_001160305_-2.33325
TGGCGACCCAGGCGAAGCGTCCACGG 2353. chr16_SLC38A7_NM_018231_1.54066
AGGGTAGGAGGTGAGCACGCTCAGGATGATGAAGGCTCGGGCAACGGCCA
CGGCCATGTCCTCCGAGGGATAGGACAGGAGCACGTCAGGATCCACAG 2354. chr16_CMTM1_NM_181269_-1.52667
CGGCGCCCTAGCAGATGCACGTGTCTGTCGAATCGCTGCCTCCGAGCCCA
CCCCCGAGCTCGCATGCTGTCACCCATTC 2355. chr16_CDH16_NM_004062_1.87314
ACAGTCGCCTTCAGGGGCACGCTGTCTGCTGGTTGATCCGGGTCCTTCTT
CCTTGACATGGTCCAGTGGGTGAAAA 2356. chr16_C16orf70_NM_025187_1.70269
CCTGGAGGTAGTGCCCGAACGCTCTCTGGGGAACGAGCAATGGGAATTC

Figure 3-192

2357. chr16_NOL3_NM_003946_1.70152
TGTGCTTGCGGAGCCGTCCGGCGGCTGGGATCGAG 2358. chr16_E2F4_NM_001950_-1.60431
GGGCCCAACAACACTGGACACCCGGCCACTGCAGTCTTCTGCCCTGCTGG
ACAGCAGCAGCAGCAGCAGCAGCAGCAGCAGCAGCAGCAGCAACAGTAAC
AGCAGCAGTTCGTCCGGACCCAACCC 2359. chr16_ELMO3_NM_024712_-1.94064
CCGCGAGGACAAGCACGAGTGCCCCTTTGCCCGGGGCAGCATCCAGCTGA
CGGTGCTGCTGTGTGAGCTGCTCCGTGTTGGGGAGCC 2360. chr16_ELMO3_NM_024712_1.55246
ACAGCCCAGGACTTCTCACCCATGTTCTTCGGCCAAGACCAGAGCTTCCA
CGAGCTCTTCTGTGTGGGCATCCAGCTGTTGAATAAGACCTGGAAGGAGA
TGCGGGCTACACA 2361. chr16_FHOD1_NM_013241_1.54661
GTTGCCCACCGCTAGGAGGGTAGCCAGGATGCAGCGGAAGGTGGCATTCT
GTACCAGCTGTTCCATACCCA 2362. chr16_ZDHHC1_NM_013304_-2.47839
GGAACAAGGATCCCAAAGCCGATCACAGCAAAGAAGAGGTACAGCAGCCA
GGCCACAATCTGGAGCGGGTGAGGGGGCCAGCTCCACCCATTCCGGCGGG
ATCGCTGGCCCTGCAGCTCAGGGGAGGGTCCGCTGGGCTGTGCCGGTGCC
GTCCACACACTCTTCTCAGGGGCCGTCTTG 2363. chr16_FAM65A_NM_024519_1.58711
TGGACCTGGTGTACACGGCGCTGAAGCGGGGCCTGA 2364. chr16_C16orf48_BC008284_1.60025
CGGCCGCCTGTAGTTGTCAGGACAGAGCGTCGGGTCTGGGGGGATGGGCC
CCGAGATGCGGGACGGGCCCTCGCACAT 2365. chr16_SLC12A4_NM_005072_1.72978
TGCAGGCACCAAAGAGAACCACACT 2366. chr16_DDX28_NM_018380_1.75173
TTCCGCCCCGGTGCTAATTATTCTTAGG 2367. chr16_PRMT7_NM_019023_1.62728
TCCACAAGAACTCAACTGGCAAGGCTGCTTTTCTGTGCTAAAACTGGGGA
GCTAGTGGGCACC 2368. chr16_PRMT7_NM_019023_-2.35811
CCCACAGAGCCACCGTCTATGCACAG 2369. chr16_PRMT7_NM_019023_1.76761
CCCGCTGTGGGAGTACCCATGCCGCAGCCTCT 2370. chr16_PRMT7_NM_019023_1.732
AGAGCCACGCAGCGGTGCTATGGATGGAGTACCACCTGACCCCGGAGTGC
ACGCTCAGCACTGGCCT

Figure 3-193

2371. chr16_SMPD3_NM_018667_1.57718
CCGAAGACACCATCAGTCGCATGGCTACTGGCAGGTGGTCCGTCAGGCC 2372. chr16_COG8_NM_032382_1.54785
AAGGACAGCCCAAAGTACATGCACTGGCCCAGCAGAGAGTCCAGGTGCCC
GCCTATGCCCCGGTAAAGGTCGGTCTCCAGCACCTGCAGGAATTGTGAGA
CCTTCTGTAGCACCCAGCCATGGAAGATGGCACTCTCATTCACAGTGTGC
TCACCCATGGCAGGGGGCAGCAGTGGGTCCTCGTCTGAGAAGATGGCACG
GTACTGGGTGATGATATCAAAGAGATGGACACGGGAGGCCTCGATGGTTT
TTGTAATATGGAAATAGGGATCATCATTAGGAATGGCAGTCAGGATGGAC
CGGAGCCAAGCATCTCGGGCCTGAAGA 2373. chr16_SF3B3_NM_012426_1.58426
TGGCATTAGAGAAGCTCGGTGCTGTCTTCAATCAAGTAGCCTTCCCACTG
CAGTACACACCCAGGAAATTTGTCATCCACCCTGAGAGTAACAACCTTAT
TATCATTGAAACGGACCACAATGCCTACACTGAGG 2374. chr16_HYDIN_AK299348_2.28651
GCTTGAAGCCGCCCCGCACTCTCCAT 2375. chr16_AP1G1_NM_001030007_1.51212
CCCGAAACCTCGAATGAAACCAGCAGCTCCGGG 2376. chr16_DHODH_NM_001361_-1.61215
AAGAACAAGACCTCAGTGGACGCCGCGGAGGACTACGCAGAAGGGGTGCG
CGTACT 2377. chr16_ZFHX3_NM_006885_1.57222
TTGGTAGTTGTGGAGTAGTTACACA 2378. chr16_ZNRF1_NM_032268_-1.67595
ACAGAGCGCCCCTGCTCCAGGGAGGAGGCTCACCGGACCCTGGGGCAGAG
CTGAGCTTGGGACACCAGCGGGAACAGGGCACCCCTTCTGCA 2379. chr16_BCAR1_NM_001170714_-1.60551
ACTGCCCATCTGGCGAGTCCTGGGAGGTGAACTTAGGGGGTGAGGGCAGG
GGTCGTGACTGGATGCTGCTGGTCTTGTCAGTGGGGTTGGGGTGCAGGGT
GCCACCCCCCTCAGGCCCCGGGGCAGTGGCCTTGGTCCGTCTGAAGAGCA
GTGAGGCATTGCCGTGCAGGAAGGAGGCCAGCTGCTTGGCGTCCTCGGGC
ACAGCCCGCGAGCAGGCCACCAGCCGGTCCAGGTCCTCAAGGGTGGCTCC
AGAGCCTCCCCGGCCAGCGTCGAGGGCCTGACCATGTGCCACCAGCGTCT
GGTGCACGTCCTCCATCTTCTGCAGCTGCCGGCTAAGCTTGGCATGCAGG
GCACGGTCAGATGTGTGGGCAGCATTGCCCACCGCGCTGCGGGCAAACTC
CAACAGCTCGTGGACGGCACTCTGGACAGCGGCCACAGCAGCCTGCAGGT
CCTGCACCAGCGGCTCCTGTGGCTCAGAGGGGCTACGCCAGCTCCCAGTC
GCACCGGCGCTGCCTGCCAGGTCCAGAAGGTGGGCAACGGTGGCGCTCAC
ACCCTGCTGCAGCCGTGCCAGGGCCTCCACAGCAACTTCCAGCTCCAGGG
GTTCCCGGCCCGGCCCTGCCACCTCCAAGGAGGACGCAGACTGGCTGCTG
CGTGTGCTGCCGGTGCTGGAGGCCGACAGGCGCTTGCCCTCTGCCGGGGC
TTCACGTTCAGCTGGGGGAGGCACCGCATACACACCACTGTCGACCACGC
CACCATCAGCCACCTCAGGAGGAAGCACCCGTTCACGGGGCACATCGTAC
AGGGTGCCCGGGCCAGGCCGCCGCAAGCCAGGGGGCACGTCGTAGAGGTC
AGGAGCCGGGGCCCGCCACCTCATACACGTCCTCGGCCGGCGGGGAGTCTG
GAGGGGGCGCAGCCAGTACCAGTGGGGTGCGGGCCGGGTCAAAGGGCTTG
GCCTTGGCGAAGGCGGGGGGCACATCGTAGGTCTCCTCACGCAGCAGTGG

Figure 3-194

GCCATCGGGCACATCCTTGCTCACCGATGGAGGAACGTCGTA 2380. chr16_---_---_-1.6411
CCTGGGCTGAAGTGATCCACCCACCTCAGCCTCCCAAAGTGCTGGGATTA
CAGGTGTGAGCCCCCACACCCGGCCTGCATT 2381. chr16_ADAMTS18_NM_199355_-1.51797
AGACCAGCGTCTCATTTGTGGGCCCTGGCGCGTACAGACGTTCCGGGCGG
TTGAAAGAGCGCTGGTATTCAAACGTGGTCCCAGCGAAGGGGAACTCCCC
AGGCCAGTCGATGCTCCAGCCCCCGGTGAGGTAATACTTTTGACTGAGGC
TTCGAACTGCGAGGTAACTGGAGGAAACCTGCAGCTCCTGGATTTCGATG
CTTCGGGCGCCAG 2382. chr16_CDYL2_NM_152342_1.66094
GATGCCATCTCCTTGACCCGCAGCATGACCTCCTGGCTGAACGTGGTGGG
CCAGAAGACCTGCGACACCAGCCCCCTGC 2383. chr16_PKD1L2_NM_052892_-1.81683
TGCTCTGTTGGGGTGTTGTCCAAATA 2384. chr16_PLCG2_NM_002661_2.82399
TGATTTCTCCCGATTCCTTCCTTC 2385. chr16_CDH13_NM_001257_1.56445
CTGGCTGGCGAGGCAGAGCCTCTCCTCAAAGCCTGGCTCCCACGGAAAAT
ATGCTCAGTGCAGCCGCGTGCATGAATGAAAACGCCGCCGGGCGCTTCTA
GTCGGACAAA 2386. chr16_NECAB2_NM_019065_-1.61641
GCCGGCGCGCACAGGCTGCTCCGGGAGCCGCCGCAGCAGGGCCGGGCGCT
GGGCGGGCTGCTGCGCTGGGTGGGCGCCAGGATGGGCGAGCCCCGGGAGT
CGCTGGCCCCCGCCGCCCCCGCGGACCCCGGCCCAGCCTCGCCGCGCGGG
GGCACCGCCGTCATCCTGGAC 2387. chr16_LRRC50_NM_178452_-1.58373
GCCCACAATCACCTGGAGACCGTGGAGGACATTCAGCATCTACAAGAGTG
TTTGAGGCTTTGTGTCCTTGACCTTTCGCACAACAAGCTGAGTGACCCGG
AGATCCTGAGCATTCTGGAAAGCATGCCCGATTTG 2388. chr16_KCNG4_NM_172347_-1.62379
TGCCTCAGTACGTCCTCCCTGTGCAGCTTGGC 2389. chr16_ATP2C2_NM_014861_1.72844
AGGAGTATGAGGACGCCGTCAGCATCGC 2390. chr16_ATP2C2_NM_014861_1.62912
GTCAGGGGCGATCGTGGCCATGACTGGGGATGGGGTGAACGACGCAGTGG
CCCTGAAGTCTGCAGACATTGGGATCGCCATGGGGCAGACAGGGACGGAC
GTCAGCAAAGAGGCCGCCAAC 2391. chr16_KIAA1609_NM_020947_-1.82219
AGTTCTCCTGAGCCGACAGCTGCGGGCTGTTGTACGTGGTGCACGTGGGC
TTGGCTCTGCTGTGTCCTTTCCCAAAATCAACATCCACCCAAAGCCCAAA
GTAATTGTGCTGCCCC

Figure 3-195

2392. chr16_CRISPLD2_NM_031476_-1.64504
ATTTGGACTGCTACACGACCGTTGCTCAGCTGTGCCCGTTTGAAAAGCCA
GCAACTCACTGCCCA 2393. chr16_ZDHHC7_NM_001145548_1.59572
ACAAATGCCCACAAGGGTTGGGTCCAGCCCAGTTTTCACTGTGCAGGCAG
ATGGTCGGCAGTCACTGGATT 2394. chr16_KIAA0182_NM_014615_1.58433
TCAGAAAGGGAGCGGCTCCAGGCAGAACTGGACCACTTACGAAAGTGCCT
TGCCTTGCCTGCAATGCACTGGCCTAGG 2395. chr16_GINS2_NM_016095_-1.5372
CTGGAGGTTCGTGCGGAGTTTGTACATGTGGTT 2396. chr16_C16orf74_BC009078_1.55113
AGGAGCCCTTGTCACATCTCACAGAACCATGAGTCGGGAAACAGATTTTG
GGAAATGCTGATCATAGGCTAGTTGGCCTCTGGGTCCAGTTGTCAGCCTT
TACCATGTGGCCCAGCCAGCTGCAGCCTCATTCCCGGCCACCAGCCCCCA
CTCTCCACAGCGCTCCAGCCTCCACTCTCCAAAGTGCTCACACTTCCCCA
GACTCCCTAGGCTCCTGGGGCCCCTTCGTGCCTTTGCATATGCTGCTCCC
CCCGCCTGGGATGCTCTTTCTTCCTCTGCCTGAGTAACAAGCTCCT 2397. chr16_KLHDC4_NM_017566_-1.89021
TGTCTTCGTCGTCGACCCCACCCTCGGCGCCCTCAACCTCCTCACTGTCC
TCTTCCGAGTCCGTCTCCTCCAG 2398. chr16_ZFPM1_NM_153813_-1.61055
GCCTCGCCCCTGCGCGCTCGCCCGGCCCCGCGGCCGACGGCCCCATCGAC
CTGAG 2399. chr16_IL17C_NM_013278_-1.71931
CACGGTACCCCACACTGCTACTCGGCTGAGGAACTGCCC 2400. chr16_FAM38A_NM_001142864_1.62182
GCGCGGGAGGCGCGTGCCAGGCAGGG 2401. chr16_FAM38A_NM_001142864_-1.66227
TGCGCCAGTAGGCAGGGAAGTCCTGGAACTGGAAGGTGTAGACGGCGATG
AGGACCAGCATGGTGTAGGCCACCACGAGCCACCAGAAGGCCTTGAGCAG
CTTCCGCCACAGGCTGTAGTAGAC 2402. chr16_FLJ40448_ENST00000333666_-1.50689
AAACCAGGCTGAGCCGGGGATCAGGCCACCTCCGCAGGGACCCACTGCTG
CCTCTTCCAGGAGCCCAGGAGACCCAGTGGGTCTCCTGCCCCCGACTCCA
ACTCCCTCCTGGCAGGACACACCCAGCTCACAGTGGCCTTTCCATCCTGG
GAAAGGGAGTGAGAGGAGGCTCAGGCCAGGGACCCGCCCAGCTCTGGCCG
GCAACCGCCCTTCAGCCTTTCCTGAACCACTGTGTGGGCCCCAACCCATC
CGCTGCCTGCCGGAGGGAGCCCATGGGGAATGGACTATTCTTGCCACCCC
TATCCATGGCAGGGGAGGGGCTCAGCATGGCTCTTGCCCACCCAGAAGAA
GGTGCAGGGGGCCTGGCGTGGTGGTTCACACCTTTGGGAGGCCGAGGTGG
GTGGATCACCTCAGGTCAGGAGTTTGAGACCAGCCTGGCCAACATGGTGA
AACCCTGTTTCTACTGAAAATACAAAAATTAGCCAGGCGTGGTGATGGGC
ACCTGTAATCTCAGCTACTCAGGAGGCTGAGGCAGGAGAATCACTTTCAC
TTAAACCCA

Figure 3-196

2403. chr16_ANKRD11_NM_013275_-1.50951
TCTGCTCCCCATTGGCGCCCGCGGTGAAGGGCAGCTTCCGCTTGCTGGCT
CGCTCCCTCACCTCCTTCCCGCCATCGCCACGCTCCAGTTTTGGGGTCTT
GGTTAGAGAAACTTTATCTTTATC 2404. chr16_SPG7_NM_003119_-1.64644
TCCCGAGTGAGCATGGAACACTTCGAGTTCCCAGGGTTATAGACAGTCGT
TCCCAGTGTGGCTGAGGCCACCCAGAGGCAGCAGAGCATTCAGACTCCAA
ACAGACCCCTGTTCATGCCGACGCTTGCACGACCGCCCCAGTTCCTGTGG
CTCCCTCGGAATGCTAAGGGGATCGGACATGAAAGGACCCTGTGAGCCGA
TTGTCCTATCTCCAGCGGCCCTG 2405. chr16_CDK10_NM_052988_-1.54842
TGTGGGCTGCATACTGGCCGAGCTGCTGGCGCACAGGCCTCTTCTCCCCG
GCACTTCCGAGATCCA 2406. chr16_CDK10_NM_052988_-1.52393
TGGGCACGCCCAGTGAGAACATCTG 2407. chr16_FANCA_NM_000135_-1.67174
GAGCACACGTCCACACATGGTCCTC 2408. chr16_AFG3L1_NR_003226_2.21725
TTTATTGGCGTTGGGCCAGCAAGG 2409. chr17_FAM57A_NM_024792_-1.50244
GGACCAAATTGTGCCCTGGGTAGCCTCAGACTTTGGGTATTGATAAGCCG
ATGGATTTGAGTTTTTCTAAAGAATATTCATATTACCTCCTTCTTCTAAC
TTGCCCTATTTGCAAAAGCACTTTTGTAGTAACAACTATTGGGTCCTGTC
AGACCTCCACGGACAGCAAAGTGGTTTTAATGCAAGCCCAAGGATCCTTC
TTAAGGTCTTATCTCAAGAGCTCTGGGAGGTGGAAGCATGGGGTGGGATC
GGTGGACCAGGGTGGTAAGTGTCTGCACATC 2410. chr17_MYO1C_NM_001080779_-1.55965
GCACTCGGGGGCTGATCTCATCTGT 2411. chr17_MYO1C_NM_001080779_2.01933
TCCCGAACCTGCTGGAGTTATCGTTCCGGAGG 2412. chr17_PITPNA_NM_006224_1.56216
AAAGTAAGTCAGGGAGTCCCAGCAGGGACTGTAAAAGAACTTGGGAAGCT
ATACACATGCCCACGATACTGACCCTGTCCCGGACCTCTCTGCATGAGAA
GGCCAGAGCCCAGCACCCCTCCTACAGAGGCACTGCTGCTTCTGTTGGGG
CTGTGACCCTGGAATTCTGATGGAAGCAGCTGGTCTGAAGGGGCATGGCA
CACACTCAGGTACTACCCCTGGAGCTGAACCTTTATCATAAGTCCCTCTG
AGTGCTAGTCAGTTTGGAGGTGGGTGAGGAGGAAAGGGGGTACTTAAAAG
AAGCCAACACTGTTGCCCAGCAGCAACACCATCCGTGGGGATGGAACAGA
CCAGGGACATCCTCCTTTATGTTTATGTGGGCTGCAATTCCAGATCCAGG
CTGACCTCAGCTCATAATGGATGCTTTTCAACTGGGGCAACAGGTGGAGG
TGGGAGGAGCCCTTGTTAGGGCTAAAGTGATATGTGTGGGTCTCAAGAGC
CAAAGGAAGGAGACTAACAGCTGCTGACCCTCAGACCACATAGACAACTG
TCTGCCTAGAATGTCAGTTTGTTTCTTTCAAGATAACCCGCATCTGGACT
TCCCCTAGTTGATGAATGAAGGAACATCTTTAAGCACAAATATAATGAAT
AGCTAACACAGAGCTTATAGGAAAACACTGACATTTTTCTCCAGTAGGAA

Figure 3-197

TGCCTCTTCTCCAACTTTCCAAGTCAGATAAATGCTACCAGCAGTTGAGA
TGCTACCCAGATGCATTACTAAAGACCCCTCAAGGTGAGGAGACTTACAC
AGAGGAAGGTGTCTGTAACAAGACATCTGGTTCCAAAGGGACC 2413. chr17_PITPNA_NM_006224_1.56005
GGTTCTGCAGTAGGGGTAAGCATTCCAGGCTTTCTCGTGTATATTCAGGG
CTCCCTCTGGGGCCAGCATTCGAACAAACGTGGGT 2414. chr17_WDR81_NM_001163809_1.5095
AGCCGACTGAACAGCCGTAAGGAGGCGGGGCTGCTGGCCGCGGTGACGCT
GACTCAGAAGATCATCGTGTACCTCTCAGACACCACACTCATGGACATCC
TGCCCCGGATCAGCCATGAGGT 2415. chr17_WDR81_NM_001163809_1.7519
CGACTGGGCGGTGGGCTGAACCCTGGGCTTGTCCGTGCCCTGGCCATCAG
CCCCAGTGGCCGTAGTGTCGTGGCCGGCTTCTCCTCAGGCTTCATGGTGC
TCCTGGACACCCGCACAGGCCTGGTTCT 2416. chr17_SMYD4_NM_052928_1.51185
GATTTCATCGTCCCATGGGCCACAGTGCAGCGACAGAACCTCCTCAGCTT
TCTGTATTGTGCTCAGGGCTTCGGGTACTGCA 2417. chr17_TSR1_NM_018128_1.60072
TGAGGCTCGGAAGCGCCTGAATCCACAGTGAAATATGAGCTCTTCCTTGG
CTTTCACAGGTTCAGTGTTGCCAGGGTCACGCCT 2418. chr17_SGSM2_NM_014853_-1.65557
TCTGGAATGCGACCGGAGCACTTGCTCTGAGGAATCCCAGGGTGACTCTG
TCGGGGAAGAATCCGGTCACAGCCTCCCCTCAGAGACAGGCCTCAGTTCG
AGGGCAGCCCATTATCTGTCGCAGACATCTGCCATGTCCCTGAGACTGCG
GGAGGCAGGGGATGCATGGGTGTCCCCATCTGTCCCTGGTGAGAAGCAAG
GC 2419. chr17_MNT_NM_020310_-1.56603
TCTGCCGCAGCACGCGGTCAATCTCCAGTACGTCCATCCACTGGCTCAGC
TCGTGCTTGAGCTCTGCCAGCCGCTGCTGCGTGGCAATCTT 2420. chr17_KIAA0664_NM_015229_-1.75481
CAGGTCGCCGTCGGTGAAGACACTCAGGAAGGACAAGGAGTTGCAGTCAA
CCCCGTTGAAGGCATCGGATGGGTCCAGGCTCTTGAGCAGGTCTCGGACA
TGG 2421. chr17_KIAA0664_NM_015229_1.59639
AAAAGCCCGTGTCCTGAATGACAATGACTTCCTGGCCGGTGGTCTCATCT
CCCGGGCCGGCCTCGTCAAGCCCATTTTCCCTGGGTGGCTCGGCCGCCGC
CGCCTCCTTCTTCAGGCTCTCTGGGCAGTCCCCGTTTAAGAGCA 2422. chr17_OR1G1_NM_003555_-1.57814
ACTGTGTCCTTCTGGGCCGAGTGGGTTGAGGGAGAACTGAAATCAACACA
AAAAGAAGTCCCAAAGAAGAGAGAGACCACGGAGAGATGAGAGCTGCAGG
TGGAAAAGGCTTTCCGCTTCCCCTGAGCTGATGGGATCTTCAGGATGGTC
GAGAAAACGTTCGTGTAAGAGATAATCAGGCAAAGCACACAAATGAGTCC
TGTGAGACCCC 2423. chr17_CAMKK1_NM_032294_-1.53213

Figure 3-198

GACGTGCGTGCGTGGAGGTCATGCAGCACGATGGGGGAGGGGCGGGAGTG
GGGCTGCAGTCCCCAGCCCCCTGCCTGCGGGGGCGGCTGTTGCATGAG 2424. chr17_CAMKK1_NM_032294_-1.50498
TTGATGTCTGGCACCCCAATTCTCGTCTCGGGATTCTTGTCTAAC 2425. chr17_ATP2A3_NM_005173_-1.7768
GGGGCGGCACGAGCAGGATGAGGAAGTGCAGGGCCATGGACATGGCCACA
GCCACCAGCAGCCAGGGGTTCATCCAGGGCGGCATCCGCAGCAGCGACTG
GTTCTCCGAGACG 2426. chr17_ATP2A3_NM_005173_1.61746
AGTGCCAGGCATGTAGTGATGACAGCCGGGAGGCCCTCGGGGATGGCCGC
CACCGCCAGGGCCACGGCGATCTTGAAGTAGTAGACAGCGCCACGCAGCC
AGGAGCCACCGTGGGCCGGGTCGGCGAAGTGGCCGATGTTGATGACCCA 2427. chr17_ZZEF1_NM_015113_-1.86398
TTCAACAGCGCAAGGTCACACAGGT 2428. chr17_CYB5D2_NM_144611_-1.67372
CGGCACTGACCCAGGTAGAAGCTGCGATCACCAGAGGCTTGGAGGCCAAC
AAACTACAGCTGCAAGAGAAGCAGACATTCCCGCCGTGCAACGCGGAGTG 2429. chr17_MINK1_NM_015716_-1.50268
CAGCGGCAGCGGCGCATAGAGGAGCAGA 2430. chr17_RNF167_NM_015528_-1.6608
ACCGGAAGTCCTTCATCTCAAGCATCCAATGCTGAAAGCGGCCTGATTTT
CTCTACCGGAAGCCCTTTTCCAGAGGCTGGGAACACGGCCCACCTAGCAG
GAAGTCCCACCTCCTTGAGCTCCGCCACCCTTCCCGAAGTTTTTCTGTCA
CCTG 2431. chr17_INCA1_NM_001167986_-1.52357
TGGCAAAGGGGATGAGGTTGACTCCATCATCCTGC 2432. chr17_KIF1C_NM_006612_-1.53591
AAAAGCACAACTCTTATCCCCAGCCACCCCAACCCTACCCAGCCCAGCGG
CCCCCAGGGCCCCGCTACCCCCCATACACTACTCCCCCACGAATGAGACG
GCAGCGTTCTG 2433. chr17_PITPNM3_NM_031220_1.56505
GACGACCATCTTCACAGGATAGACACCAACCCCCAGGCGCCGGGGCCGCG
GCACATTGTATGTGATGCGACCACTGCTGTTGGTGATCTCTGTGTCCAGG
TGTACCCAGCGGCCTGAGGATGGCTCTGCCATT 2434. chr17_BCL6B_NM_181844_-1.59533
TAAGAAGAGAAGCCGCGGCCCCTGC 2435. chr17_DLG4_NM_001365_-1.63733
TCTGGTTTATACTGAGCGATGATCGTGACCGTCTGACCCGCATTCTTCAG
GGCAATGGCAGCCTGCTCATGGCTGGCATTTCGGAGGTCCACACCGTTGA
C 2436. chr17_ACADVL_NM_000018_-2.00644
GACTGTGGCCGCTTTCTGTCTAACCGAGCCCTCAAGCGG

Figure 3-199

2437. chr17_DVL2_NM_004422_-1.67578
GGGCATCATGACCACCATCATGGGGTTGTAGGGGAGGGCCATGCCAGGGG
GCGGTCCATAGGGATGGAGCCCTGGGTGGGCTCGGAGATTAGGGGCACCC
CCAGTTGAGCCTCTGGATGGAGGAGGGCCCCCATCGCTAGTCCCACTTGC
TTCCCCACCCCGCCGAAGGCTGCCCCCTCGGCTGGAGGGCTCAGACTCAC
TGCCACTGCCGGACTTGGACTCG 2438. chr17_DVL2_NM_004422_1.85014
CCCAGTACGGGAGAGAAGCAAAGGGGAAAAAGCACGGATCTGCGAGGGTG
GCGGCGGGGGGCGGGCCGCGGGGTGCGACTCAAAGCCCCGGTCTCAGCGG
CCGCCGCGCGCCACCGCCACCGACGCCGCGAGCTTCCTCCAGGTAC 2439. chr17_GABARAP_NM_007278_1.67312
GGGTATTTCTTTCGGATCTTCTCGCCCTCAGAGCGGCGCTTCTCGAACGG
ATGCTCTTC 2440. chr17_SLC2A4_NM_001042_-1.67497
GAGATTGCTCCCACTCACCTGCGGGGCGCCCTGGGGACGCTCAACCAACT
GGCCATTGTTATCGGCATTCTGATCGCCCAG 2441. chr17_KCTD11_NM_001002914_-1.59617
GGAGGCGGCCACTACTTCATCGACCGGGATGGCAAGGCCTTCCGGCACAT
CCTCAATTTCCTGAGGCTGGGCCGCCTGGACCTGCCCCGTGGGTACGGAG
AGACAGCGCTGCTCAGGGCAGAGGCTGACTTCTACCAGATCCGGCCCCTC
CTGGACGCGCTGCGGGAACTGGAGGCCTCTCAGGGGACCCCTGCACCCAC
AGCTGCCCTGCTCCACGCAGATGTAGATGTCAGCCC 2442. chr17_TMEM95_NM_198154_1.52937
TGAGGTGTCCATGAACAAAGTCACA 2443. chr17_PLSCR3_NM_020360_1.67118
GAATTCGAGGCCAGAAGGCACCCCTGGCAGTGGCAAGAAGGGGGCAGCAG
ACCCCAAGGCCACGGGGCCAGGCGAGGGGAAGAGGGCGAAGCCGGGAGCT
GGGGCAGGTACCTGGGCGGGCACTGGCGCCTGCCCGGGCCCAGGATGTAG
CGCCGGCTCCGGGTACCCAG 2444. chr17_CHRNB1_NM_000747_-1.5751
GGGAGATTATCCACAAGCCCTCTCGGCTAATCCAGCCTCCAGGCGATCCT
AGGGGAGGGAGGGAAGGACAGCGCCAGGAAGTCATCTTCTACCTCATCAT
CCGCCGCAAGCCTCTCTTCTACCTGGTCAACGTCATTGCCCCATGCA 2445. chr17_CHRNB1_NM_000747_1.9236
CATGGTAGTGGACCGCCTCTTCCTGTGGACTTTCATCATCTTCACCAGCG
TTGGGACCCTAGTCATCTTCCTGGACGCCACGTACCA 2446. chr17_SENP3_NM_015670_1.63236
CAATAGTTTCTTCTATGATAAACTCCGTACCAAAGGG 2447. chr17_SHBG_NM_001040_-1.74705
ACTGGCTACCTCGCGCCTGCTGCTGTTGCTGCTGTTGCTACTACTGCGTC
ACACCCGCCAGGGATGGGCCCTGAGACCTGTTCTCCC 2448. chr17_EFNB3_NM_001406_-1.84933
TACCCTCAGATCGGGGACCGGCTAGACCTGCTCTGCCCCCGGGCCCGGCC

Figure 3-200

TCCTGGCCCTCACTCCTCTCCTAATTATGAGTTCTACAAGCTGTACCTGG
TAGGGGGTGCTCAGGGCCGGCGCTGTGAGGCACCCCCTGCCCCAAACCTC
CTTCTCACTTGTGATCGCCCAGACCTGGATCTCCGCTTCACCATCAAGTT
CCAGGAGTATAGCCCTAATCTCTGGGGCCACGAGTTCCGCTCGCACCACG
ATTA 2449. chr17_CHD3_NM_001005273_1.72377
GTACGGGGCGGCCTTCAGCGCCGCACC 2450. chr17_TRAPPC1_NM_021210_1.61494
AGCCCGGGCGGAGAAGAAGGGCAGAGAGCGAACATAGGAGTCCAGTCGGG
AGCGAAAGAGCTCA 2451. chr17_CNTROB_NM_053051_-1.61639
GCTGGAACCGGCATGAGGCTGAGCGGACAGAGGTTCTCAGGGGACTTCAA
GAGGAACACCAGG 2452. chr17_CNTROB_NM_053051_1.5096
GAAAGGCCATTCCCTGAGGAAGATCCTGGACCTGACGGGGAGGGCCTCCT
AAAGCAA 2453. chr17_GUCY2D_NM_000180_1.5853
AGAAATTCCCAGGGGATCAGCACATAGCTATCCGCCCAGCAACCAAGACG
GCCTTCT 2454. chr17_PER1_NM_002616_-1.50474
TGATACGGCAGAAGACGGACTTCTCCTGGGTAA 2455. chr17_AURKB_NM_004217_-2.07165
GGCTCCCATGGGCACGGAAGCGGGGAACTTT 2456. chr17_PFAS_NM_012393_-1.54596
ATGTGGCTGTTTGGTTGCCCCTTACTGCTGGATGATGTTGCTCGGGAGTC
CTGGCTCCTTCCTGGCTCCAATGACCTGCT 2457. chr17_PFAS_NM_012393_1.64396
CCGGAAGCGGCCAGACACCTTCAGCCTGGGCGTGTGTAATGGCTGTCAAC
TGCTGGCTCTGCTCGGCTGGGTGGGAGGCGACCCCAATGAGGATGCTGCA
GAGATGGGCCCTGACTCCCAGCCAGCCCGGCCAGGCCTTCTGCTACGCCA
CAACCTGTCTGGGCGCTACGAGTCTCGCTGGGCCAGCGTG 2458. chr17_ODF4_NM_153007_-1.57743
ATCTGGATCTTCGAGTTGGAAAGGAATGTATCCATCCCCATAGGCTGGAG
CTATTTCATTGGTTGGCTGGTGCTTATCCTATACTTCA 2459. chr17_NTN1_NM_004822_1.50742
GCCTTCTGCGGCAGGCGGACAGATCCTCGGCGCGGCA 2460. chr17_WDR16_NM_145054_-1.76348
CAGGCCGACTGATGTATGTCATTAACAATGCTCACAGGATCGGCGTCACC
GCCATCGCCACCACCAGTGACTGTAAAAGGGTCATCAGTGGCG 2461. chr17_MYH13_NM_003802_-1.89148
GGTTCCCAAGTGACAGTCAGTGTC

Figure 3-201

2462. chr17_MYH8_NM_002472_1.92519
TTCTTAGCACCTTTCTTCGCGCTGCTAT 2463. chr17_MYH8_NM_002472_-1.89492
GAAGCCCAGGATGTCAATGGCACT 2464. chr17_MYH4_NM_017533_1.55268
CTTCCTCTAGGGAAGTCTGTAGTTCACTCTTCTCATGATCAAGTTGTTTC
TTTACTTTCTCCAGTTCATGGATATGCTTTCCACCCTCTGCAATTTGCTC
TG 2465. chr17_MYH1_NM_005963_1.57432
TTTGGAGAGGTTGACGTTGGATTGTT 2466. chr17_TTC19_NM_017775_-2.27135
GGCGCAGCCACACACGACCTCGGTCCCGTACTTCGCGCGCTCTCCTGCAC
CGCCGCCGCCATCTCGCTCAGGAGCTCCTCCACAACCGCCGGCAACACTA
CGGCCATCGCGCCGCAGGACACGCCCTCCACGACCGGCGGACCGCCGCGA
CGCTCCAGCTGACTGCGCCTACCTGTGGAGGATCCTGACCCCCCGCCGGG
GCAGGGCGAGACGGAGTGACGTCGGGGCGCGTCATCGCGCGTGCGGACGC
AGGGATGTCCTGCTCAGTCGTCAGGGCCCGGCCAATCCGGAGGGCGCTCG
GCGCGTGGTCGGGGGCCAGGAGCGCGTCTGGCCTGCAGTGCGCAGAGGAC
GCGGCGGGAGCATGTTCCGGCTCCTGAGCTGGAGCC 2467. chr17_NCOR1_NM_006311_-1.82707
TGAATGAGGTGATGGGTCCCCTTCCTCTC 2468. chr17_TRPV2_NM_016113_-1.54317
ACTGGGCTTCATGGGAGCAGACGCTGCCTACGCTGTGTGAGGACCCGTCA
GGGGCAGGTGTCC 2469. chr17_RASD1_NM_016084_1.62733
CATGGCGAAGAGCGCGCGGAACATCTGGTCCAGGCT 2470. chr17_RAI1_ENST00000395774_1.9276
CCGTGCGATGCCCGCGCAGGGGCGGG 2471. chr17_DRG2_NM_001388_-1.55249
CGCATCCACCGGTCACTCGCCAGCCA 2472. chr17_DRG2_NM_001388_1.72456
AGCACCAAGTACAGTCCGCAGCGGGTGGGCCTGACCCACACCATGGAGCA
TGAGGACGTCATCCAGATCG 2473. chr17_MYO15A_NM_016239_2.46421
CAGGCAGCCGCCGAGGCTTTTCCAGG 2474. chr17_LLGL1_NM_004140_1.8566
CTTGCTCGGCCCCACGTGGCCAGTGTCCCCGCCAAGCTGTGGGCCCGCATT
GTGAGC 2475. chr17_FLII_NM_002018_-1.60781
TTGAGGATGAAGCAGAACTCGGAGTTGAGGAGGCT 2476. chr17_SLC47A1_NM_018242_1.69063

Figure 3-202

TTGTACTGCCCCAGATCGTAACTGGAGTTGCAGCCAACCTTGTCAATGCC
CTCGCCAACTATCTGTTTCTCCATC 2477. chr17_ULK2_NM_014683_1.82513
GCGAAGGCCCCGTGTCCCACGAGATCCCTCTTGCTGTACTCGAAGTCACC
CACCACCT 2477. chr17_AKAP10_NM_007202_1.58467
GGTTCAGGCTCAGATTCTCGGATGA 2479. chr17_USP22_NM_015276_-1.53966
GGAAGGACACATACGTGGTGATCTTCCGCCGCAGCTTG 2480. chr17_---_---_1.54803
ACACAAATATAGTTTCTACGACAACAGGCCAGGTCAGAGTGAAGCCTAAT
GAACAAACAAA 2481. chr17_---_---_-2.01647
GAGGTGGAAGGATCGCTTGGGCCCAGGAGACAGAGGGTGCAGTGAACTGT
GCTCCAGCCTGG 2482. chr17_---_---_-1.50496
AGCCTCAGCGACCTCATATTGCATGGAGCTCTTTCTTTATAAATGTTTGC
CTAAGGTGATTCCTATGTGTTTCAAAGGGTCTGACGTTTCAT 2483. chr17_---_---_-1.55967
GCATCCACAGGCTGACATGGACCGTGGAGGGGTGGCACTGTTTAAGCAGC
CCAGCACACCACTTTCTGGTGTGGTGGCT 2484. chr17_NOS2_NM_000625_1.86797
TGGGCGGCGGCACCCAAACACCAAGGTCA 2485. chr17_FLJ40504_NR_028334_-1.59125
AGCTGCTCCGTCCGCAGGGTGTAACAGGCCTCCA 2486. chr17_VTN_NM_000638_-1.55567
ACTGAGCGATGGAGCGTGGGTAGGGAGGGTCCACAGTGTCCACTCGCCGT
GTGCGAAGATTGACTCGGTAGTACTTGT 2487. chr17_SARM1_NM_015077_-1.62872
TGCCGTTGCTCGACTCTAACCGCTTGGAGGCGCAGTGCATCGGGGCTTTC
TACCTCTGCGCCGAGGCTG 2488. chr17_SPAG5_NM_006461_-1.69999
AATTGGTGGCCATAGGCTGGCAGTTGGAGTCCAGCTGGCCTGCCAGGGCC
TCCTGGAGCACTTTGGTCTCTGTCTCCGCACGCCGAAGTGAGCGGGTAAG
GTGGGTCACCTCC 2489. chr17_SUPT6H_NM_003170_1.98957
GACCCGGACACCTGCCTCTATCAAT 2490. chr17_PIPOX_NM_016518_1.54156
AAGATCTCTGGGACGCCATTGTGATTGGGGCGGGGATCCAGGGCTGCTTC
ACTGCATACCA

Figure 3-203

2491. chr17_PIPOX_NM_016518_-1.67188
CCATGGACAAAGCCGGATAATCCGAAAGGCGTACCTGGAAGACTTTTACA
CCCGGATGATGCATGAGTGCTATC 2492. chr17_PIPOX_NM_016518_1.60243
CGGGTTCAAGCTGGCCCCTGTGGTGGGGAAGATCCTGTATGAATTAAGCA
TGAAATTAACACCATCTTATGACTTGGCACCTTTTCGAATCAGCCGTTTC
C 2493. chr17_MYO18A_NM_078471_-1.51848
GCTCCCGCTTCTCTCGCAGAACCTTCTGCTTGTCCT 2494. chr17_GIT1_NM_001085454_-1.68511
AGGGAGGCCATCTCGGTCACAGCCAAATGGATCT 2495. chr17_CORO6_NM_032854_1.63033
CACGTCCAGGATGTTGCGCTTCGTGACCCGGAGCTCGCGGTGCTTGGGGG
GCACATAGCCGTCCCTCAGCGAAATGAGCACGGGTTCGGC 2496. chr17_RAB11FIP4_NM_032932_1.73699
ATCAACTTCCGGCTGAGGCAGTACATGGACAAGATTATCCTCGCCATCCT
GGACCACAATCCCTCCATCCTCGAGATCAAACACTAA 2497. chr17_SUZ12_NM_015355_-1.70269
CATTTGCAGCTTACGTTTACTGGT 2498. chr17_ZNF207_NM_003457_1.54632
TTACATGAACATACCACCCTAGTAAAGGCAAGTTCTGTAAGCTTACATTG
CTATTTG 2499. chr17_SPACA3_NM_173847_-2.26646
ACCTCACTGAATGGGTGGATGGCT 2500. chr17_TMEM132E_NM_207313_1.58728
GGGCCCCTTGGAGATCTTGCAGCTGGACTTTGAAATGGAGAACTTCACCA
GCCAGTCAGTCAAGCGGAGGATCATGTGGCACATTGACTACCGTGGCCAC
GGCGCCCTGCCTGACCTGGAGCGGGCAGTCACTGAGCTGACGGTCATTCA
GCGGGATGTGC 2501. chr17_C17orf66_NM_152781_-1.5446
CTTTCTGGAACCTTGTGGGCTCTGCCTTCACATTGGTCTTAGGTGCCTCA
TATACAGAGAGAACCTTGTTTTTCAGCTTGTTTTGGATCCAGGGATCAAT
TGAGGCACAAAGG 2502. chr17_SYNRG_NM_007247_-1.53785
TGTTTCCATGCTGGGAGTTACTTGTTTTTGAAGAAGCAGGCAACTCTTGG
AAATCACTGAATGAGTCATCAAGGGATCCTGACTTAG 2503. chr17_GPR179_NM_001004334_-1.7482
TGGGGTTGGAGCTAGAGCTGGCAGCAGAGCTGGAGCCAAGGTGGAGGTGG
GAGATAGCATCCTTGGCTCT 2504. chr17_PSMB3_NM_002795_2.11946
GTCATTGCCGGGTTGGACCCGAAGAC

Figure 3-204

2505. chr17_CACNB1_NM_000723_1.92188
GATTGATGGTGTCAGCATCCAGAGCGACCAACTGAAGGGTCCGGGCCAGC
TCGAAGATTCGCTCGATTTCACTCTGCACC 2506. chr17_RPL19_NM_000981_-1.71199
GAGGCTCGCCTCTAGTGTCCTCCGCTGTGGCAAGAAGAAGGTCTGGTTAG
ACCCCAATGAGACCAATGAAATCGCCAATGCCAACTCCC 2507. chr17_MED1_NM_004774_1.66212
ACCATGTCTTCAACTGTCTCTGCAATGAGGGACAGTGCTGGGGTGTCGGC
TTGAATGGTTTCAGCTTTCCTCCGAATAGCCCTCATCGTCACAGGGATGG
A 2508. chr17_CDK12_NM_016507_1.60505
GTTGTCCTCGTTATGGAGAAAGAAGACAAACAGAAAGCGACTGGGGAAA
CGCTGTGTGGACAAGTTTGACATTATTGGGATTATTGGAGAAGGAAC 2509. chr17_PNMT_NM_002686_1.64607
AGCGGCGCAGACCGTAGCCCCAATGCGGGCGCAGCCCCTGACTCGGCCCC
GGGCCAGGCGGCGGTGGCTTCGGCCTACCAGCGCTTCGAGCCGCGCGCCT
ACCTCCGCAACAACTACGCGCCCCCTCGCGGGGACCTGTGCAACCCGAAC
GGCGTCGGGCCGTGGAAGCTGCGCTGCTTGGCGCAGACCTTC 2510. chr17_ERBB2_NM_004448_-2.00116
CCACTGCCCACTGACTGCTGCCATGAGCAGTGTGCTGCCGGCTGCACGGG
C 2511. chr17_MED24_NM_014815_-1.79751
ATGTCTTCGCGGTGTCTCTTCTTCTGGCGGGTGGACGCCTGTCCCTTGTG
GGAGGAGTAGGAACTGAGGGCACACCACACGGCCAG 2512. chr17_NR1D1_NM_021724_-1.57152
CCACTTGTAGACTCCCAGGGGGGCTCCCATTATAGAAGGAGGAGGAGGAT
GACGACGAGGAAGATGAGGAA 2513. chr17_CDC6_NM_001254_-1.50506
TATTGCTAATACCCTGGATCTCACAGATAGAATTCTACCTAGGCTTCAAG
CTAGAGAAAAAATGTAAGCCACAGCTGTTGAACTTCCCACCTTATACCAGA
AATCAGATAGTCACTATTTTGCAAGATCGACTTA 2514. chr17_IGFBP4_NM_001552_1.54977
CGGGCCGAGGATGCGGCGCAGCGCCTCGGCGGCCAGGCTTGCTCCCCTCC
GGCACGCCTGCTAACTTCCCCCGCTACGTCCCCGTTCGCCCGCCGGGCCG
CCCCGTCTCCCCGCGCCCTCCGGGTCGGGTCCTCCAGGAGCGCCAGGCGC
TGCCGCCGTGTGCCCTCCGC 2515. chr17_KRT27_NM_181537_1.64686
GTTTGAAGAGTGCGTTTCATCTCGATAAGCTCATTCCGGGCTGAGGTGGT
GGCGCCAGCGTCGTCAGAGATCTGCT 2516. chr17_KRT16_NM_005557_-1.6885
CTCGCGGGAAGAATAGGATTGGCCA 2517. chr17_SC65_NM_006455_1.56127
CTGCTGCATGACGCTGTCCTTGGGGTCGAAGAGCATGTAGCTGGCGGCGC

Figure 3-205

TGCGGGCAGCCTGGCGCACATCATT 2518. chr17_NT5C3L_NR_033465_-1.50126
CCCGAGACCCGAGAGAACCACTGACCCCTGCGCCACGCTGGGCCCGAGGG
GAGCCCGGGGCTCGCTCGGGCGCGCGTGTGAGGCGG 2519. chr17_ZNF385C_ENST00000436535_1.77503
AGACATCACAGAGCGTGTACGATGGCCGCTTTCTTTCTCGCTTGGGCTTA
GGTGGTTCTGGGGGCCGAGGGAGGCACTCAGCAGCTCCAGATATGGGGGT
CT 2520. chr17_DHX58_NM_024119_-1.73662
TGCGCCTGTGGCAGAGGTTGTACTGTTTGCAAGGCTGTTGGCTGTGCTCC
TGCAGCTGGGGGCAGCAGTTCTGGGGTGACATGATGCACCACGTGTCC 2521. chr17_HCRT_NM_001524_-1.54434
CAGCCGCCCCGGACGACAACAGCGCGGGCGGCAGCAGCAGCAGCAGCAGC
AGTAGCGTCACGGCGGCCCAG 2522. chr17_STAT3_NM_139276_-1.52388
CTCCGCATCTGGTCCAGCGCAGTGAGCATCTGTTCCAGCTGCTGCATCTT
CTGCCTGGTCACTGACTGGTTGTTTCCAT 2523. chr17_STAT3_NM_139276_1.51635
GTGGCTGCAGTCTGTAGAAGGCGTGATTCTTCCCACAGGCACCGGGCCAC
AATCCGGGCAATCTCCATTGGCTTCTCAAGATACCTGC 2524. chr17_PTRF_NM_012232_-1.81938
CGCTGTCGCTCTTGTCCACCAGCACGGCGTCCGACTCCTCGGTGATCT 2525. chr17_PTRF_NM_012232_-1.6167
CAGCACCAGCACGCCGTTCACCTGGTCCGACTTGATCAGCTCTTCTGAGC
CGGCCCCCGACGGCTCCTCCGCTGCCTGAGCCCCAGCGGAGGAAGGCTC 2526. chr17_COASY_NM_025233_1.52216
CCAGCCCTGTGACAAGGGTTCCTGTCCAG 2527. chr17_PLEKHH3_NM_024927_-2.36528
CCACCCTCAAGGCCAGGGTGTGGG 2528. chr17_PLEKHH3_NM_024927_1.52777
CGCCAGGGCGCGCAGCGTGTCGTCGGGTGGGGGCGGC 2529. chr17_PLEKHH3_NM_024927_1.7433
GTGGGAGTCGATGGCCACAGCACAGGCACCAGCCCCCGGACAGTGCACGG
TACACAGCAGCTCCTGCCGTTGGCTCAACGCGGAAATCTCCGCCAGCGAG
GGCACCAGCTCTCTGCCGCGCGTCCGGCCCAGCGCTTTCCGGATGAAGCG
CGCATATTCCGCCAGTTCCGAGTCCGG 2530. chr17_CNTNAP1_NM_003632_-1.83042
GTACCGCACCCTATCAACTTCGGAGGCCCTCACAACTTCGTTCAAGTGCC
CGGTTTCCCACGCCGTGGCCGCCTGGCAGTCTCATTTCGCTTCCGCACCT
GGGACCTCACCGGGCTTCTCCTTTTCTCCCGTCTGGGGGACGGGCTGGGC
CACGTGGAGCTGACGCTCAGCGAAGGGCAGGTCAACGTGTCCATCGCGCA
GA

Figure 3-206

2531. chr17_VPS25_NM_032353_-1.65292
TGGCGATGAGTTTCGAGTGGCCGTGGCAGTATCGCTTCCCACCCTTCT 2532. chr17_LOC388387_NR_027254_1.84849
GTGTCCCGTCCCAGCAGATGGTGAA 2533. chr17_MPP2_NM_005374_-1.75734
TGCTTGTCAATCGCTAGCCCGGCTCTTAAAGCGGCAAGGCCTCTCCGCGA
GGGGGCGGAGGTCCGGAGGAGAGGGGAGGTGAGGAGAACGCGGAGGCCGG
CACAACTCGGAGGAAGTAGTCTTTCCCAGCAGCTGGTACGGGGGCAGCCA
GGTAGTGGTTTGGGAGACACCGCACAGAC 2534. chr17_TMEM101_NM_032376_1.66712
CAGCCCTCTCAGCGTACAGCATGAGCTGGCTGAAGCAGCCCCAAAAGGGG
CAGCGTGTGAGCAGCACCGAACCCAACTGCATGATCAG 2535. chr17_ITGA2B_NM_000419_-1.62364
TCCAAGTGGGGGCACCGACGACATATT 2536. chr17_ADAM11_NM_002390_1.82987
AGCAGCTGGACACAAGGGTCCGCCAGGAGCCA 2537. chr17_GFAP_NM_002055_1.59465
TGAGGAGACGTAGGAGCGGCGAGCAGCGGAGGTGATGCGTCTCCTCTCC 2538. chr17_MAP3K14_NM_003954_1.53613
CCATGCAGAATCCTTCGTGAGTGGAGGTATTCCAGACCCTCCAGGGCCTG
GCCCAGGTAGTACAGGGCCCGGTCCTCTGGGAGACA 2539. chr17_ARHGAP27_NM_199282_-1.62455
AGAGGTGCTGGAAGAGCATCCGCAGAGTGTCGTGGTTGGGAGCGGGCAGC
GAGCGCACCA 2540. chr17_SCRN2_NM_138355_-1.82454
AAGCTGGCCGCTCAGAACATGGCCAAGGAGCGTGAAGGGATTGCTCCACT
TTACCACCACT 2541. chr17_SCRN2_NM_138355_-1.53618
CCTGGTGTCCACGGTAGAGGGTATGCCGACGATCTAC 2542. chr17_FAM117A_NM_030802_1.72498
GCAGCTGGAAGGGGATCGTGGCCCTGAGCGGC 2543. chr17_MYST2_NM_007067_-2.01781
AGCCCGCCGGAGCCACCGTTCCTGCTGCTGCCGCCGCTGCCCGAATCGGA
ACCGTCGGGCCGCAGCCGC 2544. chr17_---_---_-1.60961
CCTGTGATTTCTGTCATTATACTCTTCTCCCCAGTTTG 2545. chr17_TAC4_NM_170685_1.51321
CAAAGAACTGGCTTGCCTTGCCCGTCTTCACCTCCTG 2546. chr17_ITGA3_NM_002204_-1.52001

Figure 3-207

TGCTACGTGCGAGGCAATGACCTAGAGCTGGACTCCAGTGATGACTGGCA
GACCTACCACAACGAGATGTGCAATAGCAACACAGACTACCTGGAGACGG
GCATGTGCCAGCTGGGCACCAGCGGTGGCTTCACCCAGAACACTGTGTAC
TTCGGCGCCC 2547. chr17_PPP1R9B_NM_032595_-2.20495
TCCTCCAGAACCCGACGCTGTGCAGTCTCCTTTT 2548. chr17_PPP1R9B_NM_032595_-1.75301
TGCCGTTGAAGCGCACCACGACGTCCAGCTTCCGGTCCTGCAGGCCGGCG
CGCTCCTGCCTCAGCAGCCGCCGCGCCGCGCTCCTTGTCGCCGCCTGCGC
GCTGGGGCGCTCCGTTCGAACAGCTTCCG 2549. chr17_MRPL27_NM_016504_-1.73202
TGTAGCCGGAGTGGGGCTTAGCAAGGATGTAA 2550. chr17_CHAD_NM_001267_-1.63251
TTTTCCGACAGGTAGAGCCAGCGCAGGTCCTTGGCTCCCTGGAAGGCGCC
TGCGCGCAGCTCACGGATCTTGTTGTTGTTGAGCTGCAAGATGAAGAGGT
TGACCAGCGGGGAGAGCAACCCCCGGGGCAGCTCAGTGACCTTGTTGTGG
TCCAGGTAGAGGTAGGTCAGCTCGGTCAGGTCGTCGAAGGCACCTGCGCG
CAGCACGCGGATGTCGTTATGGGACAGGTACAAGTAGATAAGTTGCTTGA
GGCCGCGGAAGGCACCGGCGGCCACCTCGCGGATCTGGCAGTGCTGCAGG
TGCAATGACACGAGGTTCGGC 2551. chr17_RSAD1_NM_018346_-1.83163
GGCCCATGGACGATTTATGCCCCAGGGGGCTGGAGGCCACACCCGGGAGG
CTCGGATCCAGACACTGGA 2552. chr17_EPN3_NM_017957_1.63621
CTGTGACCTCGCCACAGTGGCCCTCAGCCCTCCACCTCCGGCGGGGGCG 2553. chr17_EPN3_NM_017957_-1.982
TGGGGCTGACCCTTGGGGAGCCTCCCTGGAGACCTCCGACACACCTG 2554. chr17_ABCC3_NM_003786_1.72519
GAGTGCTGGTGACGCACGGCATTAGCTTCCTGCC 2555. chr17_ABCC3_NM_003786_-1.6421
ATCACGGCAACTGAAGCGGCTGGAATCAGTCAGCCGCTCACCTATCTACT
CCCACTTTTCGGAGACAGTGACTGGTGCCAGTGTCATCCGGGCCTACAAC
CGCAGCCGGGATTTTGAGATCATCA 2556. chr17_ABCC3_NM_003786_1.53615
GCTGCTACCCCTACATCATCTCCAACCG 2557. chr17_WFIKKN2_NM_175575_-1.8418
CTGCCGCCCATCCGCTATTCCCACGCCGGCATCTGCCC 2558. chr17_UTP18_NM_016001_1.50916
ATACCATGGATTTTTCTCCGAGAAGTGGATACTTTGCCT 2559. chr17_KIF2B_NM_032559_-1.75544
ACTGCAACCCTGCTCAGTGCTCCGGGCGC

Figure 3-208

2560. chr17_TRIM25_NM_005082_-1.92263
CAAAGGGGCAGCCTTCAGATCCAAGTG 2561. chr17_SFRS1_NM_006924_-1.5115
TCCATCGTGCATCTTAAGGGCTCCAATCGTCAAAAATAGGAAAAAAAAAA
TCTTTGGAATAGCCAATTAAGTTGAATAAAAAAATCCACACGAATGCGGT
TTGGTTGGGGCAGGAATCCACTCCTATGTTCCTGGTAATCTGATCCCGCT
CCATGAATCCTGG 2562. chr17_EPX_NM_000502_1.67623
GTGCTCTCCGGGACCAGGCCGAGCGCTGCAGCGACAAGTACCGCACCATC
ACTGGACGGTGCAACAACA 2563. chr17_EPX_NM_000502_-1.61402
TCCGGGCTGTCTCCAACCAGATTGTGCGCTTCCCCAATGAGAGACTGACC
TCCGACCGTGGCCGAGCCCTCATGTTCATGCAGTGGGGCCAGTTCATTGA
CCATGACCTGGACTTCTCCCCGGAGTCCCCGGCCAGAGTGGCCTTCACTG
CAGGCGTTGACTG 2564. chr17_MPO_NM_000250_-1.62169
GCCGTTGCGCTTGACCCCGGGCGTCCAGCCGTAGGGAAGAGAGAAGCCGT
CCTCATACTCCGCCGGCAGCCAGCGCACAAAGGCACGGTTGGAG 2565. chr17_BZRAP1_NM_004758_-1.56312
GCAGGCGGAAAGCCTGGAGTTCCTGTGCCAGGAGGCTGAACTGCTCGGTT
TGGCTGCGGCACTGTTCTTCGAGCTCTCGAACCCGGG 2566. chr17_BZRAP1_NM_004758_1.89554
AGCGTCTCCCGCTGGTTGCGCAGCGCGATCTGCCTCTGCAGCCGCAGCAC
CTCCCGCTGGGACTCGCGCAGCAGCCGATCGAAGTCCCGCACGTGGAGCC
ACTGGG 2567. chr17_TMEM49_NM_030938_-1.65147
GACGTGAGCGGGTTCCGGTTGTCTGGAGCCCAGCGGCGGGTGTGAGAGTC
CGTAAGGAGCAGCTTCCAGGATCCTGAGATCCGGAGCAGCCGGGGTC 2568. chr17_USP32_NM_032582_1.5741
CGTAGCTGAGGAATCCGATCCGTGACTCCTTGGCA 2569. chr17_PPM1D_NM_003620_-1.76989
CCAGCGGTGGCAGCCCGAGAGGCTCGCGACCCTCTCCCGGACGCCGG 2570. chr17_BCAS3_NM_001099432_-1.71042
GCTGGAGACTAGCGTTAACCGGCGGG 2571. chr17_BCAS3_NM_001099432_-2.69101
TGATGGCATTGTGGCCCACTTCCCT 2572. chr17_TBX2_NM_005994_2.26475
CGGGGCTGCACGTCTCGGCACTGGGCCCGCACCCGCCCGCCGCGCATCTG
CGCTCCCTCAAG 2573. chr17_C17orf82_NM_203425_-1.84958
AGCTGACCGCGAACTCCTGCGTGGGGTGCTCCTGGGGCGGGAGGGGCGCG
CTCAGCCTCGCTCTCCCCGGGACTCTCACGCTCAAG

Figure 3-209

2574. chr17_TBX4_NM_018488_2.13679
GACCTGGGCGAGTGACTCGTTGTGTGCTGTGCCCGCAG 2575. chr17_ACE_NM_152830_-1.53074
TGACAGTCACCCATGGGACAAGCAGC 2576. chr17_TACO1_NM_016360_-1.50304
GACAGTGTAGGGTCATTAGCTGTTGAGCCGCCCCGGGCGGGCCCAAGCCT
TTGGATCTCAGGTGACCGGCACAGGCGGCCGCGGGGTCCGGAACTGCTTG
TTCCGGCAGTGGAAGAGACGCGCCGGCGTTGGCCGCTGCTGCTAGCAGCT
TGAACCCCAGGGTC 2577. chr17_CCDC47_NM_0201981.70784
GGCCTCATCATCCGGGCCAGGACATTCAGTAAGTCTT 2578. chr17_SMARCD2_NM_001098426_-1.63562
AGGTCTCGGCGCTGGGAACGGAGCCATTCCTGGATGAAGTCCTGGGGGTC
GGTGCTAAAACTGAGCATGAAATC 2579. chr17_CD79B_NM_000626_1.51439
TGGCTATGAAACGTGGGCTCTGCCAGATCCGCGAACAAGCACTAC 2580. chr17_ERN1_NM_001433_-1.53695
GCAACCCCCTCGTGTACCATTGAGGGAGAGGCATA 2581. chr17_GNA13_NM_006572_-1.8927
AGTTGAAATTCTCGACGCCGGTCATAGGCATTCTGTATGCCGCTGTCTGC
CCATAATGCTCTTATAGCAGGAAGATATTGTAAGAAAACCCTTGTTTCCA
CCATTCCTTGGGCTGCCATGGGGGCCCGGGTATCAAACGACATCATCTTA
TCTCCATGTTGTTGGTTTGAGTTGTCTCCCCAGGGAATATGAAGCTT 2582. chr17_ARSG_NM_014960_1.53299
GGGCTGTACTGATACTCCAGGCTACAACCACCCTCCTTGTCCAGCGTGTC
CACAGGGTGATGGACCA 2583. chr17_WIPI1_NM_017983_-1.53728
CAATTGCACTCCATTCTTCCGCCTTCCTTGTTTTCTCCAAAACCACCTGA
TAGGGGGGATGTCCTGATTTCTGA 2584. chr17_FAM20A_NR_027751_-1.72319
AGATTTCCCAGTGCACTCAGGAGATCGTCGGTGGCCTTGATGAAGCCAGT
GCTTTTTGGGAAAAACGGAGCAAGGCAACGCACGACAGAAGCGGTGCACC
AAGGAGTAAAGATTCAGTTCCATGGGCCCCACTTGCTGTTTGAGAAAATG
TCCTGCTTCCTTCCTAGCTGACTTGACTCCCAGCAGTAACAGGT 2585. chr17_ABCA8_NM_007168_1.54754
GGCCCAAGTTTGTTGACACACACTG 2586. chr17_SOX9_NM_000346_1.58112
GCCGCAGGCGGCGCCCCCACAGCAGCCGGCGGCACCCCCGCAGCAGCCAC
AGGCGCACACGCTGACCACGCTGAGCAGCGAG 2587. chr17_COG1_NM_018714_-1.77579
TGGTATGTACAGTCCTTCCTGTTT

Figure 3-210

2588. chr17_TTYH2_NM_032646_-1.75616
GCGTGGACTACATCGCTCCCTGGTGGGTCGTGTGGCTGCACAGCGTCCCG
CACGTCGGCCTGCGCCTGCAGCCCGTGAACAGCACCTTCAGCCCCGGCGA
CGAGAGTTACCA 2589. chr17_CD300A_NM_007261_1.89402
TGGCATTGTTGCTGCTTCTGTTGGT 2590. chr17_CD300LF_NM_139018_1.88627
GCCAAGAGTGAGGCGGCCACCAAAAGCAGC 2591. chr17_GRIN2C_NM_000835_1.55577
GAGCCTCCGCTGATGCTGAGGATGGGCACATGGGTCTGGGAGGAGATGAA
GTCAAGGATCTGGGCCACCGCCTCGGTGTCCACGTTGTCCTCAAAGACAA
TGCCGTGGACGTGGGCAGCACCCAGGAGGCCGCAGATCTGGGTGAGGAGG
CTGCTGGGGTTGGTGGTGTTGACCCCAACTGTGAGCGGCTGGATCTCCAG
GGGTAGGTCCAGGAAGCTCTGGGGGGTGAGGCGGGCACGGAACTGGGCCT
GGGGCGGCCCTGAGCTGCTAAACACCACAGCCACCGTCATGCCCTGCTCG
CCCTGCCCCGGACCCAGCCCTGCCCAGGCACCGAAGAGCGAGGTGAGCAA
CAG 2592. chr17_LLGL2_NM_004524_1.55428
GCTCTACCTGGGCACCGAGAGTGGCAACGTGTTTGTGGTGCAGCTGCCAG
CTTTTCGTGCGCTGGAGGACCGGACCATCAGCTCGGACGCGGTGCTGC 2593. chr17_LLGL2_NM_004524_1.5534
CGGCAACTGGCGTTCACATCGAGCCGCCGTGGGGTGCAGCCT 2594. chr17_SAP30BP_NM_013260_-1.51103
ATATGTTTGATCCCCATGGCTGGTCTGAGGACTCCTACTATGAGGCATTA
G 2595. chr17_ITGB4_NM_000213_-1.56108
GCTGCCTATGGCACCCACCTGAGCCCACACGTGCCCCACCGCGTGCTAAG
CACATCCTCCACCCTCACACGGGACTACAACTCACTGACCCGCTCAGAAC
ACTCACACTCG 2596. chr17_ITGB4_NM_000213_1.54562
GCCAGCCACCGCATTCCGGGTGGATGGAGACAGCCCCGAGAGCCGGCTGA
CCGTGCCGGGCCTCAGCGAGAACGTGCCCTACAAGTTCAAGGTGCAGGCC
AGGACCACTGAGGGCTTCGGGCCAGAGCGCGAGGGCATCATCACCATAGA 2597. chr17_EXOC7_NM_001013839_-1.51201
TGGTCCAGGCAGGACAGCGTCTTCTCAACATTCTCCTGCAGCCGCTGCAG
ATTCTCCGTCTGCTTG 2598. chr17_FAM100B_NM_182565_-1.69136
TCAGCGGCAGTCCCCGAACGTTGGGCCGGCCCAGCCCCGCCCCGCGCTGT
TGTTTGTGGTGTCGGCCGGGCCGCGGGAGTCGAACCACAACATTCGCCGG
GCGGGCGGCGGCGGAGCGGGCGGCGGAGCGGCGGCAGCAGCGGTGAGCGC
GAGCCC 2599. chr17_QRICH2_NM_032134_2.06834
AAGCTGAGCTCCTCGGCGGCGTCCTT

Figure 3-211

2600. chr17_SPHK1_NM_021972_-1.77499
TCAGCGGTTGCGTGGAGCCCCCGCCCAGCTGGAAGCCCCAGCAGATGCCA
CCGCCAGAAGAGCCCTTATGA 2601. chr17_UBE2O_NM_022066_1.54965
ATCTGGTTCTTCAAGTCGTAGACCTTCCCCAGCCAGCAGTCATAGGCAAT
GTAGTCCCCATACATGA 2602. chr17_RHBDF2_NM_024599_-1.51772
ACTTCTCGCAGAAGCGGCTGGTGAAGGGGAAGCAGGTGAGGTGCTCGATC
CAGGGCCAGTTAATGGGGTAGATGTACAGCCACAGCACGAGGGCGGCGAA
GAGGCCGGCAAAGGCCAGCAGTGACACCAGGATGAGTGCCCGCTTGCGGT
ACTTGTCGCTGGTGCCGAAGGTGATGTAGGGCAGGAAGGCGAAGGCCAGC
AGCAGGCCACTGAGGAAGCCGAAGAT 2603. chr17_RHBDF2_NM_024599_-1.67
CTCTTGCGGCGTGGCAGGTGGGAGTAGCCAGAACGGACACTGGTGAAGGA
GGTGAGGGACAGGACTCCGGGGGTCAGCGGTGGGTGCGGGGCGTGGGGCC
TGTCCATCTCCTCCGGGTGGCGGAA 2604. chr17_RHBDF2_NM_024599_1.61328
AGCATGCTGTCCTGCTCGCCAGGGGCCTGGGTCTCTTTCTCGGGTGGCGG
GATGGTGATGGAGAGGTTGGGTGGCTTCCGGCTCTGCAGGCGGCTGCTGG
ACACAGAGGACACGCTCCCGCCATTCTTGTCAGC 2605. chr17_RHBDF2_NM_024599_1.50926
TCGAGTCTGAGTTTGCCCGCGGCTTCCTGGGTCTTGCTGTGAAGGGCTTT
AGAGCATGTTCTTGTCTTCTCCTTGCTCTGTACAGATGCTCCGGTGTCAA
GCCTCAGTCTGTGGAAGGGTGGCTGGACAGACAGGTGGCTGGAAGGACAG
ATAGACAGCTCCAGGC 2606. chr17_TMC8_NM_152468_-1.65371
CCGCGGTCGGTGTCATCGGAGCGGGCCCCTGGGGTGCCGGAGCCGGAGGA
GCTGTGGGAGGCAGAGATGGAGCGGCTGCGCGGCTCTGGGACGCCCGTGC
GCGGGCTGCCCTATGCCATGATGGACAAG 2607. chr17_TK1_NM_003258_-1.6364
GCCCCTCGTCGATGCCTATGACAGCCACGCCCAGGGCCTCCTGGGCCACG
TCTCGGAGCAGGCAGGCG 2608. chr17_GAA_NM_000152_-1.80986
GAGGCCCGCGGCTGTTGCTACATCCCTGCAAAGCAGGGGCTGCAGGGAGC
CCAGATGGGGCAGCCCTGGTGCTTCTTCCCACCCAGCTACCCCAGCTACA
AGCTGGAGAACCTGAGCTCCTCTGAAATGGGCTACACGGCCACCCTGACC
CGTACCACCCCCACCTTCTTCCCCAAGGACATCCTGACCCTGCGGCTGGA
CGTGATGATGGAGACTGAGAACCGCCTCCACTTC 2609. chr17_CARD14_NM_024110_1.61885
ACCAGGCTTGGCATGGTCTGAACTGGAAACCCTGAGAATGTTTCTGCAGT
GGGACAGGAGGGACGTCTTCCCATGCCTTCCCTAGAACCGGAGGCCCCGG
ACTTCTCTGGAAAACCGCCTGTCTGCAGGCCCCGATTCAAATCTATGGGGG
CTGCACTTCCCTTTTACATTTTGATGTGTCAAAGGCTTTTGGAGTGACCA
AAAGCACAGAGGCAGCGGGTGGGGCGCCTGGGTGGTCCCCAAGGTCGCTG
CCACCCTTGCCCGGGGCAGAGGCAGAAGCCCACATATGCTGTGACGCTGG

Figure 3-212

CCACCTTTT 2610. chr17_RNF213_NM_020914_-1.52324
GATGCGCCTCAGTGTCTTTTTAAAGAAGCAAGAAGAGAGCCAGTTTCACC
CTCTGGAGTGGTTGGCAAGGGAAGCCTGCAACCAGGACGCTCTCCAGGAG 2611. chr17_RNF213_NM_020914_1.51297
GAGCCCGGATCTTGTGCTGCTTTTCTCACTGACGTGTTGCCTTTTTTCTT
TACAAAATCTGCTTTGATACTTAGGACCTCTCTGGACTAATTTCTCTTCC
TAGACAGCTCAGCACAGCTATTGATATGTTAGAGGCAGTATCCTTAATAT
TCATTCTAAATGAGTTAACGACTTAACTTGAAATTGGGCCTAAGGAGTGA
GAACTACAAAAATACAAAATGCTTGTCCAGGACTCAGCCATGCACACCTT
GAGCAGCGCCGGCAGGAGGCACGGAAGGAACTGTGCTCCGTTCTCCTCAC
TGTCATGGTGCCACCAGTGTCTGATGAAGGGCAGAGTGACCCAGACTGCA
GGCAGTAACTGACTTCACACAGTCCCTGGCATTTAGTCATCTGTGATTGT
TTTATCACTCTGGACTGTGCAGAGCCACCTGCCACCGAGATCTGCATTCC
GACTG 2612. chr17_NPTX1_NM_002522_-1.99297
CGCTGCTCCGGAGCTCCTCGGCGCCGCCGGCGGCCACGGACGCGGCGCAC
ATGTCGGCGTCCACGGGCACCGAGGTGCAGATGAAGCGCGTCGGCCCGAA
ATC 2613. chr17_C17orf56_BC064483_1.80375
GGCCTTGTTGGTCACAGGTCCCGGGCTGCCCATGCTGAGCTCCTGCAGCC
ACGGCCGGGTGCGGAGGAGGATGTGCTCCT 2614. chr17_C17orf56_BC064483_1.56481
CAGGTAGCCCGGACACGGGACATCATCATCGGACGTCCCCTTCAGGAGAA
TCGGGA 2615. chr17_TSPAN10_NM_031945_1.5768
GACCGCCACGCACAGGGATACAGGGGGCGCCTCCGCCCGGCTAAAAAGCG
CGGCCTGCGCCGCCGCCGCCGCCTGATTTCGCTCGGGCTTCGGGTGACTT
CGCCGCAGGACCTACCCAGCTCGCTCACTTCGCTCGCTCCGCGTCCCCCA
TGCCAGCCCCCAACGCAGGGCGCCCGGCGAAGCCACGGGACTGGCGGGAG
GAGCACGCGGGGCCGGAGGAAATCCTGAAGCTGACC 2616. chr17_CCDC137_NM_199287_-1.5645
AGGGAGAGGAGCCCGACATCGCAGTCCCCAAGTTCAAACAGAGG 2617. chr17_HGS_NM_004712_-1.57096
ACAAGAACCCACACGTCGCCTTGTATGCCCTGGA 2618. chr17_HGS_NM_004712_-1.76679
TTCTTCCAAGTACTCCACCATCCCCAAGTTTGGCATCGAGAAGGAGGTGC
GCGTGTGTGAGCCCTGCTACGAGCAGC 2619. chr17_SLC25A10_NM_012140_-1.63942
ATGCAGAACGACGTGAAGCTGCCCCAGG 2620. chr17_STRA13_NM_144998_1.95127
CGTCCACACGGAGCGCGTCTTCTGCCTGGGCCTGCCGCACGCCGCGGACT
GCTG

Figure 3-213

2621. chr17_DCXR_NM_016286_-1.83997
CCAGCACCCGGCGGCCCGCGAGGAACAGCTCC 2622. chr17_GPS1_NM_212492_-1.64928
GCTCGGCCTCCTCGTCAGTGACAGATCTGTACT 2623. chr17_CCDC57_ENST00000392346_2.72322
CCCAGCTCTGCACGGAGCCTGTTC 2624. chr17_CSNK1D_NM_001893_-1.7079
GAGAGGTATCTTGTCGGCCTGTGAGGTCGGACGAGGAGATGTTGACGGGG
GCCCCGCGGTGCAGCCGCATACTCACTTTCCGCTCTCTCTCCATGCCGGA
GACGGG 2625. chr17_NARF_NM_012336_-1.62911
CTGGGTCCGATACGCCGAGCGGGTGCTGGGTCGCCCCATCACTGCCCACC
TCTGCACCGCCAAGTCCCCCCAGCAGGTCATGGGCTCTTTGGTGAAGGAT
TATTTCGCCAGACAGCAG 2626. chr17_NARF_NM_012336_-1.59156
TGCTGCATACCACGTACCAGAGCCAGGAGCGTG 2627. chr18_ENOSF1_NM_017512_1.61269
CATCCTTCAGCGCCTGGGCACAGAG 2628. chr18_TGIF1_NM_003244_-2.74608
ACAGCGCCGAGGTGCGCCGAGCAG 2629. chr18_LGAP1_NM_004746_-1.66258
GCAGGTACTGGCAGGAGCGTTCTTGCTGACACGACTCGGACTTCACCATG
GCCTGGTCCATGTTCACCGAGGCCTTCTGGTAAACCTCCCGGGCCCGGCT
CACGGTGAGCGTGGAGGACCAGGCGCTCTT 2630. chr18_EPB41L3_NM_012307_-1.62262
GGGAGATGTGGGGGCACAATGGGTGGATGGGGGTGACAAGGGACATGAGT
CAGTGCCAAGCCCAG 2631. chr18_EPB41L3_BC008377_-2.19421
AGAAAAAAAGTAGCGCAAGGGCAGAGAGAGGTAGG 2632. chr18_L3MBTL4_NM_173464_1.89251
TTTTCATGCTCTGGAAAGGACTGA 2633. chr18_KIAA0802_BC040542_-1.59022
CTCCAGGCCCGAGAGACCAGCAAACCGTCGCCCTCCGTCCCGTTGGGCCC
CACATTCCCCCACTGCCTCACAGCCTCAGTCACCCGGAGACCCGACGTCC
TTGGAGGAGCATG 2634. chr18_FAM38B_NM_022068_1.56109
GCAGGCCGACCCACTCTGTAGGATCGATAGGAGCGCTGTAGAGCAGAGAC
TTGTTCAACTCATTAAAGGG 2635. chr18_IMPA2_NM_014214_-1.78255
CCCCCCGGAGTACTTCAGAATGCAA

Figure 3-214

2636. chr18_SLMO1_NM_001142405_1.66963
CGGGACGGAAAAGCACGTCTGGCTGCGAGGGCACACAGGGCCGGGGAGGA
GGATTAGGCTGGACTGATCGCGGGTCGCAGGTGACCCCGGGACCAGATGT
CCCTCCCCTCATGAGCGTGCAACAGGGAGCAGCCCCAGCCAGCCCCACCG
CCGCCGTCTGCGTGGATGGA 2637. chr18_PTPN2_NM_002828_-1.74605
GCTGGCGCGAGCAGAGCCTGCGCCGGCGGAGAGGCTCAGGCCCCGCACGA
TCCGGGGAGAGCGCTGGCGCTGCGGCGCATGCGCGCTGCGCGCCGCGCCC
CGCCCCCACGCCAAGCCCTGTCGGCCGTGGGGAAAGTACCTGGAGCGTCG
GACGTCA 2638. chr18_CEP192_NM_032142_1.60929
CAAAGAATCTACTCCTTAAACCTGG 2639. chr18_C18orf1_NM_181481_-1.79165
TGGCCTTCAGACAGCGCCGCACCGCGGCTGGGC 2640. chr18_GREB1L_AK293321_1.65378
GAGAAGGGCTTCGAAGATAAACTGAGCTCCATTCCCCTGGCATGAAACTT
TCAGATTCCCCTGCCTCTAGAAATTGTC 2641. chr18_LAMA3_NM_198129_1.52417
TGTCACCCGGGATGATGATGTACTTTGTGTTACTGAATATTCCCGTATTG
TACCTTTG 2642. chr18_DSC3_NM_001941_-1.51645
ATTCGGGCATACATGCAGACCAGGTGGTTTTCAGCATGTTCAAAGAACAA
AGAGATGGTTAGAGGTTTTATAAACAGGGAAGTGATACTGGTTGCTCTTT
GAGAAAGTTTATCGGCACTAGTAAAGTCTTGGGGAGGTAGCAGGTTTTGA
TCGGTGAGTGAGGGAGTGAGCAAAACACAGTGGGTGTTTCAGTAGCCGTT
AGATAAAACTGGCTTCTGGATACAGCAGGAAATTTCAGCAACTAGGCTTA
CAGAGAATTCCA 2643. chr18_B4GALT6_NM_004775_-1.61091
GGCCGGACTCGGGGCCACTGTCCA 2644. chr18_C18orf34_NM_001105528_1.50895
TAACCATCGTTTTCGCATGTGCCATCTGTCAAAGTCTGGAAGAAACCTAA
GATGTGTTGCATTAAA 2645. chr18_MOCOS_NM_017947_-2.00852
AGCTGTGGACCTTCGCGGGTTCCCG 2646. chr18_MOCOS_NM_017947_-1.54982
TGTACCTGATGCATGCATCATTGGATTTATCCTCCCCATGTTTC 2647. chr18_KIAA1328_NM_020776_1.53288
CTGGATGGTTCCTACTTGAGCATAGCCAGACCACAGACCTACTATCAAAC
CAAGCAAAGACCTAAGTCTGCAGTCCAGGATTCAGCTTCAGAATCCCTTA
TAGCATTTAGGAATAATTCTTTGAAACCAGTAACCCTTCATCATCCCAAA
GATGATCTAGATAAGATACCATCAGAGACCACAACATGTAATTGTGAATC
TCCAGGGAGAAAACCTGCAGTCCCAACAGAGAAAATGCCACAAGAAGAAT
TGCACATGAAGGAATGTCCACATCTTAAGCCTACTCCTAGTCAATGCTGT
GGTCATAGACTTGCTGCAGATCGTGTTCATGACAGCCATCCTACAAACAT

Figure 3-215

GACCCCTCAACATCCTAAGACACATCCAGAATCATGCAGTTATTGTCGGC
TTTCTTGGGCATCTCTGGTGCATGGTGGTGGGGCACTGCAACCCATTGAA
ACTT 2648. chr18_SETBP1_NM_015559_1.56423
AGCCAGCCGCAGTTGACAGTGTTACAATTCCACCAGCCCCAGTGTTATCT
CTCCTTGCTGCATCTGCAGCAACGTCGGATGC 2649. chr18_CXXC1_NM_001101654_-1.85371
GGCGCAGCCGGCACTTCTGCCGGATCTTGTTGGGGCCCC 2650. chr18_ME2_NM_002396_-1.60559
TGTTCTCCCTGACCACTTTGGTTGATGTATTTTTTCCATGCGTCTCCACA
TCTGTTGGGGTAGACGTGTTGATTGATTGCATTGCCCACCAGCACCCTAC
AGTCAGATAGTTGTGATGCTTTAATTCTAACATACAGCCCGTACCACATC
CAGGAGATGTAAAAAGTGTGTTTGTGAATGTCTTCACTTGTACTCTAATT
CAGACTTGCCAAAGTATTTGCTATTTACTATTATGGGTAATACTCTTCTC
TGGCCTAGTTCTTACAGAGCTACT 2651. chr18_TCF4_NM_001083962_-1.65595
ATACTGTCTGTCCCGTTGGCAGGAGGCGTACAGGAAGAGGTGCTGTAATG
GTTTGTACCACTACGATGGAAAGTGGACATCGGAGGAAGACTGGAATTGA
TGTCTGC 2652. chr18_ONECUT2_NM_004852_2.18775
CCAGCGCCTGTCCGGCAACGTCAG 2653. chr18_FECH_NM_001012515_1.55002
GCCACACCAGTCGGTAGGGGTTGCAGTACTCCAGCCTTTCCATGACTTTT
TGGACAGTGGCGCTTAC 2654. chr18_----_----_-1.65323
AGTTAGCTGGGTATGGTGGCATGCACCTGTAGTCCCAGCTACTCGGGAGG
CTGAAGCAAGAGAATCACTTGAATCTGGG 2655. chr18_----_----_-1.6646
AACTACTGGAAATCTGGCTGGGCGTGGTGGCTCAAGCCTGTAATCCCAGC
ACTTTGGGAGGCTAAGGAGGGCAGATCACCTGA 2656. chr18_MALT1_NM_006785_1.59923
GAAGGACAAGGTTGCCCTTTTGAT 2657. chr18_CDH7_NM_033646_-1.53955
CGCTCCGAGCTCAAGCGCTGGATAGGCTCACCAACAAACCCGTGGAGCCC
GAGTCGGAGTTTGTCATCAAAATTCAGGATATCAACGACAATGAACCCAA
ATTTTTGGATGGCCCATACACGGCAGGAGTTC 2658. chr18_ZADH2_NM_175907_-1.5539
TTCAATCAGAACGGGCCCATGGGGTTTCAGCGCAACGGTGACAGCGGCAG
CAGTCTTCAGGGCACTAAAGGTTAAGAGGGA 2659. chr18_ATP9B_NM_198531_1.50251
GAAAGATGAGAACATCCCTGGCACGGTCGTTCGGACCAGCACTATCCCAG
AGGAACTTGGGCGCCTGGTGTATTTATTGACAGACAAAAC

Figure 3-216

2660. chr18_NFATC1_NM_172390_-1.51052
CAGAGCACGGACAGCTATCCGGTCGTGGGCGGGAAGAAGATGGTCCTGTC
TGGCCACAACTTCCTGCAGGACTCCAAGGTCATTTTCGTGGAGAAA 2661. chr19_BSG_NM_198591_-1.71653
TGAAGCAGTCGGACGCGTCTCCCCAAGAAAG 2662. chr19_BSG_NM_001728_-1.69445
GCTGTGAAGTCGTCAGAACACATCAACGAGGGGGAGACGGCCATGCTGGT
CTGCAAGTCAGAGTCCGTGCCACCTGTCACTGACTGGGCCTGGTACAAGA
TCACTGACTCTG 2663. chr19_PALM_NM_002579_-1.8097
CGAGTCTCCAACACGCCCCTGAGGACGGTTGACGGCTCCCCCATGATGAA
GGCAG 2664. chr19_MED16_NM_005481_-1.61387
CACACCATTGTGCAGCCAGGACAGGGCCACAATGGGGTCCCCCTCCACTA
GGCTGCCCACTGAGCTCTCCCAGCTATTAGCCAGGTGGTCCGCCATGCTC
CAGCACTTGATCTGCCCGTCGGCATCTGCTGACAGGA 2665. chr19_C19orf6_NM_001033026_-1.67787
CCTCCCAGCGTCGCGCCCTAACGACCCGCAAGTGTCCGAGGGCGCCT 2666. chr19_GPX4_NM_002085_1.94507
GCCTCGGCCGCCTTTGCCGCCTACTGAAGCCGGCGCTGCTC 2667. chr19_SBNO2_NM_014963_-1.50935
GCATATATTAGCAGGGGTCTGCCCCACGGAGCCCCCGAGACGCGGGGCCC
TGAGCACCTGGGGTTTCCTGAGTTTCTAGCTCTTGGGACCACCCGGTTTC
ACGGATTTCAAGGGTTTGGGCCCACTGAGCCCTTGTGGG 2668. chr19_SBNO2_NM_014963_1.80259
CCCGGCGCACGCAGCCCTCGGGGATCTTGAT 2669. chr19_C19orf26_NM_152769_-1.52302
GTTGAGGCGCTGGTGGACGTCCCAGCAGCGCTTGCAGAGGAGCAGGACGC
CAGACAACACCACCAGCGTGCCCCCCACGAACAGCGACAT 2670. chr19_C19orf26_NM_152769_-1.60215
GCGTCCAGTGGCATTGTCCCACGACGTCGTCAGGGCTACTG 2671. chr19_CIRBP_NM_001280_1.61994
CAAGTCGTCAGACAACCGATCCCGTGGGTACCGTGGTGGCTCT 2672. chr19_MUM1_NM_032853_-1.6484
GGGCCTCGTACTGCCTCATGGAAAATCCTCCGGAGCCGCC 2673. chr19_APC2_NM_005883_-1.51501
GCGCAAGGAGATGCGCGTCCTGCACGTGCTGGAGCAGATCCGGGCCTACT
GCGAGACC 2674. chr19_APC2_NM_005883_-1.67286
CCATCGAGCCGCAGATCTGCCAGGCCACCTGTGCTGTTATGAAGCTGTCC
TTTGATGAGGAGTACCGCCGTGCCATGAACGAGCTAG

Figure 3-217

2675. chr19_APC2_NM_005883_-1.64986
AGTCCACCCTGAAGAGCGTGCTGAGCGCCCTGTGGAATCTGTCTGCACAC
AGCACAGAGAACAAGGCGGCCATCTGCCAGGTGGATGGCGCCCTGGGCTT
CCTGGTGAGCACCCTGACCTACAAGTGTCAGAGCAACTCGCTGGCCATCA
TCGAGAGCGGCGGCGGCATCCTCCGCAATGTGTCCAGCCTCGTCGCCACC
CGTGAGGACTACAG 2676. chr19_PCSK4_NM_017573_-1.97687
CAGAGACCACGATGCCCTGGCCTGACAGCCCCTGACTCCAGGCCTGCAGG
ATGCTCAGGTCTGGTTGGGCCTCGCTGTT 2677. chr19_TCF3_NM_003200_-1.73902
GCCCTTCCCGTTGGTGACAGGCAGCGGGAA 2678. chr19_ATP8B3_NM_138813_1.9636
TCATGTTGATGTCGTTGGCACCGTCCCCGATGG 2679. chr19_REXO1_NM_020695_1.57345
CTCGTCCCCAAAGAGGTCGGCGTGGCTCAGGGCCCGCTTCTTCAGCTTGG
GGGCGTCCTGGGAGGCGCCCTCGTCTAGTGAGCGGGCTTTCCGCTCCACT
AG 2680. chr19_MKNK2_NM_017572_-1.55208
CACTCATTCACAGTAACGGTTCTGACCAGTCCTCCAGGTCGCACGTGGAT
GCGACAG 2681. chr19_MOBKL2A_NM_130807_-1.81615
CTTCTCGGATTCCTCCAGGAACAGTGGAGAAGACAAGGCAGGAATCAGCT
CTCAGAATTCCACACCAAGGCCTTCTGGGCTCCCCCGGTCTTCCCACGGA
CGAGACACAAGTGACCC 2682. chr19_AP3D1_NM_001077523_1.7133
TTCACCAGGAGGCAGACATGGTGGCCCTGGATGGAGCGGCTGTACATGGA
GGCGCAGGAGTCCACTCGCTCCA 2683. chr19_AP3D1_NM_001077523_-1.61027
TGCAGACTGCCCCGGATGTCACAGGT 2684. chr19_AP3D1_NM_001077523_1.60999
GGTGCTTGGGACGCCGCTGCTCCTCCTCGTGGAAGACGGCCCTGGGCCTC
TCGTCCTCTGACTCGCTGTCCGAGAGTGGCTCATTGATCCAGGCGTCCA 2685. chr19_DOT1L_NM_032482_-1.62776
CCCGCCCGCGCTGCAGAAGCTTCTA 2686. chr19_PLEKHJ1_NM_018049_1.8275
TCTTGGGGCCCCTCATGCCCAGCTCGGCCGCCATCTCGGCCGGCTGCCGG
GACAG 2687. chr19_C19orf35_NM_198532_-1.77032
CGCACCACGCGGTAATACAGGGCGTCCCCGCTCTCTGCGCAGGGTGAGCT
GTCTAGGAGGCGGAAGCTGTGGCCGGGGTGGCAGGGCCCGGGGTGGCCCC
CCATGAGCCGGGCACGGAGCCGGGCATAGATGGTACGGAGGCCCTGCAGC
TGCCGCGCAGCCAGTGCAGTGTGCACAGCCTCCGGGCTGTGCAGATCGCG

Figure 3-218

GAGGGAGAGGCCCAGTGGGGCGTCAGCCGGGCCAAAGGTCAGCTCTGCAG
GGAGACAGGCTGGTCCCACTGCAGCCTGGCTCTTGTCCACACTGTGGGAC
CCCAGAAAGGGTCTCCGAGGCGGCTGTACTTGGATG 2688. chr19_SPPL2B_NM_152988_1.66173
CTATGGCGTTGGCCTCCTTGTGACATTCGTGGCACTGGCCCTGATGCAGC
GTGGCCAGCCCGCTCTCCTCTACCTGGTGCCCTGCACGCTGGTGACGAGC
TG 2689. chr19_GADD45B_NM_015675_-1.76585
CAACCCAACCCACGAGGACCATCGGGGGCAGAGTCGTTGGAGACTGAAGA
GG 2690. chr19_ZNF77_NM_021217_1.63584
CCACTTCCTCAAAGATCACGCAGTC 2691. chr19_GNA15_NM_002068_-1.5001
GGAGAGCCTCGCATTGTTTGGGACTATCCTGGAACTACCCTGGTTCAAA 2692. chr19_NCLN_NM_020170_1.74361
AGGAAGCGGGCGAGGTGCTGGAGAAC 2693. chr19_NCLN_NM_020170_1.53937
GGAGGAGGCAAGTTTAACTACCAGGGAACCAAGCGCTGG 2694. chr19_CELF5_NR_033342_-1.99571
GCGGACGCTCCGGCGCATGCAGCAGATGGTGGGCCAGCTGGGCATCCTGA
CGCCGTCCCTCACATTGCCCTTC 2695. chr19_FZR1_NM_001136198_1.55132
AAACCCACCCGCAAGATCTCCAAGATCCCCTTCAAGGTGCTGGACGCGCC
CGAGCTGCAGGACGACTTCTACCTCAATCTGGTGGACTGGTCGTCCCTCA
ATGTGCTCAGCGTGGGGCTAGGCACCTGCGTGTACCTGT 2696. chr19_MRPL54_NM_172251_-1.71571
TGGGAGCTCCTAAACCCCGCCACTTCCGGAAGACTCCTGGCCCGGGATTA
TGCCAAGAAA 2697. chr19_DAPK3_NM_001348_-1.63996
TGCCGGCACTTCCGCACGATCGCAAA 2698. chr19_EEF2_NM_001961_-2.06193
ATGGGGATGCAGGCGTGGTCCTCCTCCAGGTCCTTCAGGCAGATCTCCAG
GTGCAGCTCGCCGGCGCCCGCGATGATATGCTCTCCCGACTCCT 2699. chr19_DPP9_NM_139159_-1.63083
ATTAGCCCCATGAGCGAGAGGAAGCCCCCGTAGGACCAGCCATGGATGGC
AACTCGGCTCAGGTCGATGAAGCCATACTTCTCGGCCACGAAC 2700. chr19_C19orf30_NR_027148_-1.51158
ATCAAGGGAAACGATCCTTATTGCCTCACCATTTCCCACGTGAAGTCTGT
ATTGACATTCTCATAG 2701. chr19_TICAM1_NM_182919_1.52679
TCTACAGAAAGTTGGAGTGGCGTCTGGTCTTTGACAGAGCAGGGGTTTTT

Figure 3-219

GACCGGCTCCAGAATAGGCAAGGGGAGAGACTGGGGGCCTGCAGACCCCT
CGGTGCACTCCACTGGGTAGTTGGTGCTGGTTTCTGGAGCTGCGGGGTA
TCAGGGAGGCCAGTGGAGGTTGCATCTGGGGCCACTTCGGGAAGCCCAGG
AGGTGGGCTGCTTGGCAGCTCTGGTGGGCTGGCAATCTCCCCCGATGGCG
GCCAGCTCATCTCCTCAGGCTCCTGGCAGCCACCGGGGACAGGCTCGGGC
ACCAAGCTGGCCTG 2702. chr19_PLIN3_NM_005817_-1.52187
AGGTGTGTTCTGGGCCACATATTCCACCATGTGGTCCAGGGCCTCGCGGG
CGCTGGCGACACGCTCACGGCTCTGGGCCAGAATGCTGCTGGACAGGTCC
TGGAAGGAGTGGATGCTGGAAAACGTGGCCTGGAGGTCCTCCACCTGGCG
GCGGGCCTGCTGCACCTGGTCCTTCACATTGGTGGGGAGGCCCTGAATGC
TGGACCCCAGGGAGGTACAGGTGGCCTGCAGTTGCTGGGCAATGTCCCGG
AACATGGTGAGCG 2703. chr19_PTPRS_NM_002850_-1.55442
GGCTCCAGGACAGCGTGATGCTGGTCTCCGACCTGGCCTCGGCCCGCAGG
TTCATGGGCT 2704. chr19_PTPRS_NM_002850_1.52792
TTCACCGTGATCTGAGCAACCGCCTCAATGACGCCCAGGCTGGACATGGC
CACGCAGGTGTAGTTGGCCGAGTCCTTGACATCTGTGAGTTCCAGCACGT
TCCGACCCACGGGCATGTCATCCTCGGGGGTCAGGTCCTCGGCCCCCTGC
ATCCACTTCACGTATGGCATGGGCGAGCCCACGGCCACGCAGGTGATGTT
CACGTTGCCCCCTGGCATGATCTCGTGGCTCATGGGCAGGAT 2705. chr19_ZNRF4_NM_181710_-1.59415
CCCTGGTCGTATCAGCCTTCTTTGTCCTGAACCACCTGTGGCTCTGGGCC
CAGGCCTGCTGCAGCCACAGACGGCCGGTGAAGACGTCTACCTGCCAGAA
GGCCCAGGTCCGCACCTTCACGTGGCACAACGACCTGTGTGCCATCTGCC
TGGATGAGTATGAGGAGGGCGACCAACTCAAGATCCTGCCCTGCTCCCAC
ACCTACCACTGCAAATGCATTGACCCCTGGTTCTCCCAAGCCCCCCGGCG
CTCCTGCCCCGTGTGCAAACAGTCGGTGGCCGCCACAGAAGACAGCTTTG
A 2706. chr19_NRTN_NM_004558_-1.51808
CCGGATGCGATGGAGCTGCGCGAGCTGACGCCCTGGGCTGGGCGGCCCCC
AGGTCCGCGCCGTCGGGCGGGGCCCCGGCGGCGGCGCGCGCGTGCGCGGT
TGGGGGCGCGGCCTTGCGGGCTGCGCGAG 2707. chr19_FUT6_NM_000150_-2.03672
TGACCGCGTCTGCCTGTGGATACACCT 2708. chr19_RFX2_NM_000635_1.57015
CCGGCCTCAGCACGTCGGGGATGAGAATCTCCACCAGCGCCTGGTAGAGG
ATGTGGTCGCAGCTCCTCATCCACCTGAGGATGGGGTCGCACTGACACAG
GGAGATAAGCTTGTCCTTGGGCA 2709. chr19_GTF2F1_NM_002096_2.18617
CTGGCATCACTGGCATCGGACGACATCTCCAGGTCGTCCTCCAGGTCGTG
GATGCGCAGCTCGCTCGCCTTCCTGCGGCCACGTTTCTCCTTCTCCTCCT
CATCCTCGTCCTGGTCCTGATCCTTGAGCCGCCGCT 2710. chr19_KHSRP_NM_003685_-1.63252
CTGGGGTGGGTACTGGTGAGGAGGG

Figure 3-220

2711. chr19_SLC25A23_NM_024103_-1.68231
GGCCAGCCCCTGGCGCAACTCGTGCACGTCCACGCGGCCATCCTTGTTAC
TGTCCAGCTCCTCGAACAGGCGACCCCAG 2712. chr19_DENND1C_NM_024898_-1.74735
TAACCCTCAAAGCACTTCTTAAGA 2713. chr19_CD70_NM_001252_-1.51862
CGGGAGAGCAGATTCCCACGGCCAGGGTGGTGGGGTGGTGCCTGGAGGCC
GTCGTGGAGGAGCAGATGGCCAGCGTCACCTGGATGTGTACCATGTAGAT
GCCATCACGATGGATACGTAGCTGCCCCTTGTCCAG 2714. chr19_INSR_NM_000208_1.58221
GGCCGCAGAGAACGGAGGTAGCTCTTCAGGTCTCCGTGAGCCATCAGCTC
CATCACCACCAGCGTGGGCTGGCCCTTGGACACCA 2715. chr19_ARHGEF18_NM_015318_1.50299
TCCAGAGCCTGATCTGCAGGCAGCTGGGCAGCGCCAACGGCCAGGCGGAA
GACGGAGGCAGCTCCACAGGCCCGCCCAGGAGGGCTGAGACCTTCGCGGG
CTACGACTGCACAAACAGCC 2716. chr19_EVI5L_NM_001159944_-1.57566
GGACATGCCCGTCAAGAACCAGTACTCCGAGCTGCTCAAGATGTCCTCGC
CGTGCGAGAAGCTGATCCGCAGGGACATCGCCCGCACCTACCCGGAACAT
GAGTTCT 2717. chr19_MAP2K7_NM_145185_-1.84624
CAACAGGACAGTTTCCCTACAAGAACTGCAAGACGGACTTTGAGGTCCTC
ACCAAAGTCCTACAGGAAGAGCCCCCGCTTCTGCCCGGACACATGGGCTT
CTCGGGGGACTTCCAGTCCTTCGTCAAAGA 2718. chr19_SNAPC2_NM_003083_-1.59785
CTCTTTCTGAGGATCCCGTCATGGGGGAAGGTCCTTGAGATGATGCTCAG
CTGTGGGGCGGGCCTCTAAGATGCCCCATACTTTGGGGGTCTCAGAAATG
GAACCCCCGTTGTACAGGGGTTGGGTGGGGGTTGCAGGACTCCACTCACA
AGCCTCCTGATGTCAAGGACAGGCGGACAGGGCTGGCCTCCCCCAGTCCC
CAAGCCCCACTGTGCCTTGTTGTCTGCTGGGGGGCCATAGCTGGCACTGC
CCACCGTAAAGGCCCTCGCACATTTTCCCCCTTCCTGTACACCTCGGGGC
CAG 2719. chr19_ELAVL1_NM_001419_-1.66236
AATCTCTGCGCCTGGTGGTGAACGGGGCCTCCGAACCGTCGCGCTGGCGA
GTGGTACAGCTGCGAGAGGAGTGCCACGTTTTTGTTCTGGTTGGGGTTGG
CTGCAAACTTCACTGTGATGGGCTCAGAGGAACCTGGGGGTTTATGACCA
TTGAAACTGGTAATTGCCTCTTCTGCC 2720. chr19_CD320_NM_016579_-1.90294
GCGCAGTTTCTTGTCAGTTCCCCC 2721. chr19_KANK3_NM_198471_1.66576
TAGGTGTAGTGAGCCAGACGAGGCAGC 2722. chr19_HNRNPM_NM_005968_-1.55697
GTTACTGGTTGCGTCGGGTCACGTGGGCGCGCAGGCGCAGCGCGGTGCAG

Figure 3-221

CCCGTTCGCTCACACAAAG 2723. chr19_----_----_-1.79322
GGCCTCAAATGATCCCCCCTTCTTGGCTTCCCAA 2724. chr19_---_---_-1.5313
TTATATGTTTAGTAGAGTCGGAGTTTCAC 2725. chr19_ADAMTS10_NM_030957_-1.59145
TGGCAGGCCTCCAGTACAGGTGGGCGCGGCTGCGGGCATGCGCTGTCGTC
CAGCGCCTTCTCCTCCGCGGCAGAGACGCGGCGCTGGCACACGACCGAGC
GGCTGCGCACGCCTGCATCGCAGCTGCGGCTGCAGAGCGACCAGTTCCCT
ACAAC 2726. chr19_ZNF317_NM_020933_-1.65701
GAGAGAAGTCCACTGAATACGCTCACTTGTTCGAAGTCTTTGGCATGGAC
CCTCATCTCACTCAGCCAATGGGAAGGCACGCTGGCAAGAGGCCCTATCA
CCGCCGCGACTATGGGGTAG 2727. chr19_OR7D4_NM_001005191_-1.67213
ATACACCTGAGTGAGGCACCCCATGTAGGAGATGTCTTTGCTCCGTGCCT
GCATGCTCACTAGCAT 2728. chr19_COL5A3_NM_015719_1.94928
GTGGCTGCTGTCGTCTGGTTGAAAGACAGCTCCTCTCCATTGGTGCCAAG
GAAGCGGGCGGAGTGGCTGTAGTCACCCGTGGCTTCGTCCAGCCAGGCAG
CTGCATTCTGGCAGGAGTAGGTGAAGTTCTGGCGAGCTGTGGCACTCAGC
AGTTTCAGGAAGTTCAGCTGCACGACATTCACTGGGGACCCGTCGGCGTC
CACGTAGGAGA 2729. chr19_C19orf66_NM_018381_1.54893
GTGCTCACCCCAAGAGCCGGAAGCAGAACCACCTGCCCAAAGTGCTCCAC
CCCAGCAACCCTCACATTAGCAGTGGCTCCACTGTGG 2730. chr19_DNMT1_NM_001130823_1.51162
CATCTCTGGGATGTTATCATCGACTTCCTCATCGTCATCTGCCTCCTTCA 2731. chr19_ICAM4_NM_001544_1.82431
TTCTATGCCGGCTGAGCGAGAAAAAGAGGAATATGAAACAATCTGGGGAA
ATGGCCATACATGGTGG 2732. chr19_RAVER1_NM_133452_-2.11889
GTGACCATTAGGCCCGGGGCTGAG 2733. chr19_RAVER1_NM_133452_-1.5947
CTGGAGGGACGCGGATGGGCCCAGGTTGTTGAGCAGCTGCAGGATGTTGG
GCTCGGGGAGGAGTCCCT 2734. chr19_ATG4D_NM_032885_-1.58597
CTCCCAGCCGGTACCATGGGCCTGCCCGCTGGATGCCCCCACGCTGGGCC
CAGGGTGCCCCTGAGCTGGAGCAGGAACGCCGGCACCGGCAGATTGTGTC
CTGGTTCGCCGACCACCCCCGGGCCCCCTTTGGCCTACACCGGCTGGTGG
AGCTTGGGCAGAGCTCAG 2735. chr19_ATG4D_NM_032885_-1.60939

Figure 3-222

TGCTGTACCTGGACCCTCACTACTGCCAGCCCACTGTGGATGTCA 2736. chr19_SLC44A2_NM_020428_-1.51904
CCTGGAGAGGAATGACGGCTCGGCCGAGAGGCCTTACTTCATGTCTTCCA
CCCTCAAGAAACTCTTGAACAAGACCAACAAGAAGGCAGCGGAGTCCTG 2737. chr19_QTRT1_NM_031209_-1.53228
CGAGACGTGCCTGGCTTCGCCATCGGGGGCCTGAGCGGGGGTGAGAGCAA
GTCGCAGTTCTGGCGGATGGTGGCGCTGAGCACC 2738. chr19_LDLR_NM_000527_2.26488
TCTGGGCGACGTTGCTGGCAGAGGAA 2739. chr19_LOC55908_NM_018687_-1.78949
TCACGCTGACAAGCAGAGCCACATCCTATGGGCCCTCACAGGCCACGTGC
AGCGGCAGAGGCGGGAGATGGTGGCACAGCAGCATCGGCTGCGACAGATC
CAGGAGAG 2740. chr19_RAB3D_NM_004283_-1.58281
GGTCGTCGGCGAGCCTCCGGCCATCCTCAGCAGGCACAACACGTTCGTCC
TCCAGGTCACACTTGTTCCCCACCAGGATGACCTGGGCGTTGTCCCAGGA
GTA 2741. chr19_EPOR_NM_000121_-1.52433
TGGGAGAGCAGCGCGAGCACGGTCAGCAGCACCAGGATGACCACGAGGAT
GAGGGAGAGCGTCAGGATGAGGGGGTCCAGGT 2742. chr19_CCDC151_NM_145045_1.75571
CACTTGCATCGCCCGCAAGGCGCGCTCCAGCTGGTCCTTGGCCTCGGCGT
GCCGCCGCTCCTCCTTCTTGAGACGCTCCTGCGCCTCGG 2743. chr19_ZNF44_BC136502_-2.81123
TCCCCTGGTTTTTGTACTGCTCTT 2744. chr19_ZNF709_NM_152601_1.62152
CAAGTTAACAAAGGTTTCTTGCATC 2745. chr19_MAN2B1_NM_000528_1.57819
GGCGCTCAGGTTACGTCCGGAATCCTCTCCTACGGCAAA 2746. chr19_C19orf56_NM_016145_1.97388
GAGGCCGCACATGCTGAAGATCATGCCCAGCAGGTTCATGTAGTCCGGCG
TCGGGTCGTCCAAGGCCGGGTTACATTCGCTCGGCG 2747. chr19_TNPO2_NM_001136196_-1.62678
AGCGGCGGCAACTCGCGCTGCGGCTTCTCCA 2748. chr19_ASNA1_NM_004317_1.68029
GCAGTCCAGCTCTCCAAGGGGCGTGAGAGTGTTC 2749. chr19_JUNB_NM_002229_1.52475
GGAACAGCCCTTCTACCACGACGACTCATACACAGCTACGGGATACGGCC
GGGCCCCTGGTGGCCTCTCTCTACACGACTACAAACTCCTGAAACCGAGC
CTGGCGGTCAACCTGGCCGACCCCTACCGGAGTCTCAAAGCGCCTGGGGC
TCGCGGACCCGGCCCAGAGGGCGGCGGTGGCGGCAGCTACTTTTCTGGTC

Figure 3-223

AGGGCTCGGACACCGGCGCGTCTCTCAAGCTCGCCTCTTCGGAGCTGGAA
CGCCTGATTGTCCCCAACAGCAACGGCGTGATCACGACGACGCCTACACC
CCCGGGACAGTACTTTTACCCCCGCGGGGGTGGCAGCGGTGGAGGTGCAG
GGGGCGCAGGGGGCGGCGTCACCGAGGAGCAGGAGGGCTTCGCCGACGGC
TTTGTCAAAGCCCTGGACGATCTGC 2750. chr19_MAST1_NM_014975_1.5419
AAGAAGCGCAGCTCCCTCTTCCGGAAG 2751. chr19_GCDH_NM_000159_-1.54594
TGCCTGCAGCTCGGCCGCTTGAAGGACCAGGACAA 2752. chr19_CALR_NM_004343_-2.58735
GCAGAGCTGGCCGCGCCAAATAAT 2753. chr19_NFIX_NM_002501_-1.68021
CCAAGCGCCCCAAGTCCATCGATGACA 2754. chr19_CACNA1A_NM_000068_-1.69833
TAGGCTGGCTGTTGGGCATGTCGGTAGGGGGGCCTTGTTCCGGACTCCAT
GTGCCCGTCTTCTGGAACATCTCCTGGGCACGCTGGGTCACCCAGGACGG
GCTCTCCTTGAGGCCGCTTTCGTGAGCCAT 2755. chr19_CACNA1A_NM_000068_1.8194
GGAGGGGAGGGCGTTCTGGCCAGGTCCCCCTTCCTGCGTTGGGGACGGGG
GCTCCATGCGCTGGAACATGAGGGGTGTCCGGTC 2756. chr19_---_---_-1.67308
CCGCAGCTTCTTCCTCTTAGTCATTTTATCTTCCCCTTGAGAAAT 2757. chr19_DCAF15_NM_138353_1.59933
GCTCCCTGAAGGTTCTGGCGGACAGCGAGCGATATACGTGGATCGTGCTG
TGA 2758. chr19_RFX1_NM_002918_-1.50032
CCTGCTGGGTACCATGGACCGTCAGGGAGACCTGGCCACCTTTGCTGCCT
GGGGCTGCGCTCTGCACCACCA 2759. chr19_DDX39_NM_005804_-1.86295
GGAGGTGAAGCTGCATGCGGGCGGCTCCG 2760. chr19_PKN1_NM_213560_2.17963
AGGCCAATAACCCCTCGGAGCAGGA 2761. chr19_PKN1_NM_213560_2.11473
TGCTTCGGAGGAACCCAGAGCGGAGGCTGGGATCTAGCGAGAGAGATGC 2762. chr19_SYDE1_NM_033025_-1.72959
GGAGCCCGCCGGCGAGATCTGGTACAA 2763. chr19_ILVBL_NM_006844_1.67905
GGCAGCGGTCCCTCGGGCTGAGGCTCCCAGGCTCCTGCAAAGAGGTTGGC
CAGGTAATTCTCTAAATAC 2764. chr19_NOTCH3_NM_000435_-1.60353

Figure 3-224

AGTCGTAAGTGAGGTCGCCACTCTGCCTGCAGGTGCCCCCGTTACGGCAT
GGTGAGGGTGCACAGGGCACCGCGGGGTTCTCACATAGTGGCCCTGTGTA
GCCAGC 2765. chr19_AKAP8L_NM_014371_1.60369
CGGTTCCGGTTGTGATCCATGGTCTTCAGATGCTTCTGGATGATCCCAAA
CTGCATGGGAATGAAGAGGTCGCAGGCTGCACAATGGGCTGCCTCCACCT
TCTTCACAAAATGCTCCATGGCAATTT 2766. chr19_RASAL3_NM_022904_-1.5298
TTTGGGTGCTCAGCGACTCCACGAGGCGGGACAGCACTTTCTGCTCCTCA
CGCAGAGCGGCCACCTCGCACTGCAGC 2767. chr19_CYP4F22_NM_173483_-1.58833
CTTGGTCAGCATCTATGGAACCCACCA 2768. chr19_CHERP_NM_006387_1.5107
GGAAGTCGTCCTGCATGAAGCGGGGCGGGAAGCGGTTGAAGTTGTGGGGG
TGCGGAGGCTGGTTGAACTGCGGGTGCTGCTGGTGGGGCGGGAAGGGCCC
CCGGAAGTGTGGGGGCCGCTGCATGCGGAAGGGTGGCTCGCGCTGGCCCC
CGCCCCAGGGCGGCTGCTCGTGCTGGCTGTTCCAGGGGCCCTCGAACTGG
CTGTT 2769. chr19_CPAMD8_NM_015692_-1.51295
CTGTTTCCAGGAGAGCAACCACCACGTAGGCTGTCAGCGGGACAGTGCCG
TGGATCCC 2770. chr19_USHBP1_NM_031941_-1.56871
AGAGACCCAAGGATCTGGGTGCTGGAATGGCTGCGGAGGCGCCGAAGCAG
GGGGTGAGC 2771. chr19_FAM129C_NM_173544_-1.81621
CTTGGAAGTGCCTGTGAGCTTCCCGCTGTTCCTGCAGCACCCCTTCCGCC
GGCACCTCTGCTTCTCTGCAGCCACCAGGGAGGCACAGCATGCCTGGAGG
CTGGCCCTGCAGGGTGGCATCCGGCTTCAGGGC 2772. chr19_FCHO1_NM_001161357_2.35228
GCACCATGAAACGCCATTCTTCAC 2773. chr19_KCNN1_NM_002248_1.51321
ACAGCTACAATGGCAGCGTGGGGCGGCCGCTGGGCAGCGGGCCGGGCGCC
CTGGGACGAGACCCTCCGGACCCTGAGGCCGGCCACCCCCCACAACCCCC
GCACAGCCCGGGCCTCCAGGTGGTAGTGGCCAAGAGTGAGCCAGCCCGGC
CCTCACCCGGCAGCCCCCGGGGGCAGCCCCAGGACCAGGACGATGACGAG
GATGATGAGGAAGATGAGGCCGGCAGGCAGAGAGCCTCGGGGAAACCCTC
AAATGTGGGCCACCGCCTGGGCCACCGGCGGGCGCTCTTCGAGAAGCGGA
AGCGCCTCAGCGACTATGCCCTCATTTTCGGCATGTTTGGCATCGTCGTC
ATGGTGACGGAGACCGAGCT 2774. chr19_PDE4C_NM_000923_-1.54937
GCCCTCCTCCCACACGAGAGCCCATTTTCCAG 2775. chr19_LRRC25_NM_145256_-1.55463
TACGTAGAGACACCGGAATCCTAGCCCTGACCTCAGCCCTGTGGTCGCCC
TCGCCTCCACCGCCAGTGTTTATTATTA

Figure 3-225

2776. chr19_----_----_-1.6492
ATTCTGCAAGACCCCTCTGCCATGCCAGGGCACGCCCATTCCAGCTGGAG
TCGTGGGGCTGGGCACAGGGGAATTTTTCCAGAGCTGAGCCTGACGTCTG
CTCTGAAGAATGCTTAGAAGGTTCCCAGACACCAGA 2777. chr19_C19orf60_NM_001100418_1.71608
GGGATGCGCCGAGGGAGATGGGAAACGGGGCGGATGGCGCCCAGCCCAGC
CCTAACTGCCAGCTGGCTGGGGTTGCGCCCCACTGCGCTGCTGACCTTCC
TGCAGTTCCAGACACCTCCCACAATAAAGAGCTC 2778. chr19_COMP_NM_000095_1.55335
GCTCTGGCCCTGTCCGGACGCGCCGAGGGCAGCCAGGGTGAGCAGAAGAA
CGCAGGCGGTGTCGGGGACCAT 2779. chr19_GDF1_NM_001492_1.71949
CGGAGCGCAGGGCGGTCCAGCCCAGCGCGC 2780. chr19_ARMC6_NM_033415_-1.93019
TGCTGATCCGAAACCTGGTGGCCCACGGCCAGGCCTTCTCGAAGCCCATC
CTGGACCTGGGGGCTGAGGCACTCATCATGCAGGCCCGATCTGCCCACCG
TGACTGTGAGGACGTGGCCAAGGCCGCCCTGCGGGACCTGGGTTGTCATG
TCGAGCTCC 2781. chr19_SF4_NM_172231_-1.96425
GAGGGGCGCTGGGCGCACTGGTCGGGGCGT 2782. chr19_GATAD2A_NM_017660_1.60544
GCCCTCGCTCCAGCTGAACGCCTCCATTGCTGCTTGTTCTGGAGACCCCC
GCCCCCGCACCTTCCAGACTTAGCAGAAGAACAAACTGAAGAACAGACCC
AGCCAGAGAAGCAGGGATTCCAGAAGCTGCCCATTAAGGGAGAAGGA 2783. chr19_PBX4_NM_025245_-1.73628
GCCGCGAACGCAGGGTCATCACTGCCTCACAGGTGCTCTGCTTCAACTGC
ATCTGGATGGCGCTGAACTTGCCGTGAATGGCGCCGACCATGCGCTCAAT
CTCCTTAGGGGAGACAGGCCTCATCCTGCTCTGCTCCTGGAGGAGGTTGG
TGACGTGCGTGGTGAACTCAC 2784. chr19_ZNF254_NM_203282_1.53601
GCCTTTAATCGGTCCTCGCACCTCACCACAGATAAGATAACT 2785. chr19_C19orf2_NM_003796_1.76957
CCAAACGTAAACGAAAGAACAGCACTGGCAGTGGCCACTCTGCCCAGGAG
CTGCCGACCATCAGGACGCCTG 2786. chr19_SLC7A9_NM_014270_-1.72777
TTTTGGAGACTGGTGGTCTTAGGCTCTTGGCTCTGGATCGACTTCTCATC
CTCTCTCCGCTTTCTCAGGCCAGTAT 2787. chr19_RHPN2_NM_033103_1.71034
CCGCACGGCTTTCAGGATCTGCTGATTCAAAGCAGCTCTTTGATTCTGCA
ATTTACTCCGGCCGGTTTG 2788. chr19_GPI_NM_000175_2.15044
CCGCCCGGGAGCGGATGTTCAATG

Figure 3-226

2789. chr19_----_----_-1.59044
ACCACCTCCTTCATGCTCCTCTGTGATCACCTCTCCAAGTCCCGGTGTCA
GGAGCCTTCTCTGTGGCCGCCCTGGAGAGACTTGAGCCTGGGACGTGACG
TGCTGGGCTGTGAAGCTTTCTGAGAAGGGAAACCTGTGGCCTGACCTGCC
TGAATGCTGCAC 2790. chr19_GRAMD1A_NM_020895_1.50347
GAGAAGCTGCACCAAGGCATCACAGTCTCAGACCCTCCCTTTGACACCCA
GCCCCGGCCCGATGACAGCTTTTCCTGA 2791. chr19_FXYD5_NR_028406_-1.64043
CCATCCACGCCCACATCTCTCTGCCTCCTCTCCTGGGCTACAGTGGGCCG
CTCTGCCTCGCTCCCGCCCGCCT 2792. chr19_FXYD5_NR_028406_1.77655
CACTTTTTCCTCTGAGCGCGGGAGGCGTTACTCACTCTTCCTCCTTCCCC
TCCTCGCCGACTCCCGGGCTCTGGGCCCCTGGGGGAGGGAAGAGGCCTCC
TATCTACTCCTCTGCCCCAGTCCCCTCCTTGCGTCAGTCCCAGTGAGGGA
TAAGCGCCTGGCGGAAGGCGCAGGGAGGTGTTTCTCTGCTTCAGGAGTGC
CCGCCGGCCCTTGCAGCTGCTGGAAGACCCATTTATCTCATG 2793. chr19_USF2_NM_003367_-1.5151
CCTGCGATTACATCCGGGAGTTGCGCCAGACCAACCAGCGCATGCAGGAG
ACCTTCAAAGAGGCCGAGC 2794. chr19_ATP4A_NM_000704_1.51902
GGCTCGTTGACCAATCTGTCACGCTTTGGGTTGCGTGGACGCAGGTGCAT
GATGTCACTCTCGGCCTTTTCATATGC 2795. chr19_HAUS5_NM_015302_1.68064
GAGACCCAGGAACAGGTCCGCCTGCTCATCAAGGGAAACTCGGCCAGCAA
GACCCGC 2796. chr19_RBM42_NM_024321_-1.57612
AGTATGTGGGCTCGCGCCCCATCAAGCTTCGCAAGAGCATGTGGAAGGAC
CGGAATCTGGACGTGGTCCGCAAGAAGC 2797. chr19_ZBTB32_NM_014383_1.61286
GGGACAGGGCTAAAAAGCCAGATCCAGGCCTGAAGAAACATCAGGAGGAG
CCAGAGAAACCCTCAAGGAATCCTGAGAGAGAACTGG 2798. chr19_298_MLL4_NM_014727_1.52634
GTGGTCACCACTCCTGTTAAGGCCGAGGTGTCCCCTCACGGGGCTCCAGC
TCTGAGCAACGGGCCACAGACACAGGCTCAGCTACTGCAGCCCCTGCAGG
CCTTGCAAACCCAGCTCCTGCCCCAGGCACTACCGCCACCACAGCCACAG
CTGCAGCCACCGCCGTCACCACAGCAGATGCCTCCCCTGGAAAAAGCCCG
GATTGCGGGCGTGGGTTCCTTGCCGCTGTCTGGGGTAGAGGAGAAGATGT
TCAGCCTCCTCAAGAGAGCCAAAGTGCAGCTATTCAAGATCGATCAGC 2799. chr19_U2AF1L4_NM_001040425_1.5963
GGAGAGGTCCTGCCAGGAACATCTG 2800. chr19_U2AF1L4_NM_001040425_1.56371
GTTCTGGGAAATGGGCCGCAGATGCATGAAGTTGCAGAAGCCACCTCGGG

Figure 3-227

TACATTCC 2801. chr19_LIN37_NM_019104_-1.55083
CTGCAGATCCCGCATCCCATCTCCACTG 2802. chr19_C19orf55_BC110893_1.8734
ATTCCCCACCAGCTCTGATGGCCTCTCTCCCTTCTCGGAGACCTTCATCC
CTGACTCCAGCAAGGGCCTTGG 2803. chr19_PRODH2_NM_021232_1.92186
CCAGCAGCGAGAGCGCAGGGTTCAGTGAGGTGTACTCCGCATCCACCAGG
AGCCGCACGTGCTGG 2804. chr19_APLP1_NM_001024807_-1.8514
ACCTGCGTGCGGAGCAGAAGGAACAGAGGCACACGCTGCGCCACTACCAG
CATGTGGCCGCCGTGGATCCCGAGAAGGCACAGCAG 2805. chr19_COX7A1_NM_001864_1.58916
CCTTGTCCTCTTCCGCCGGAGTCACCTCCCTTCTCCGCCCAAGGACACGC
GTAGTCCTCCTCTGTCCAGGAACCCCAGGCCCCACCCGCTGCGCGCAGCG
TGACAGCTGGGGACGCGGCGGGGCTGGGGCTGGGGCTGGGGCTGGGTTGC
GGGGAGTCCTGCTCCTCGGATTCGTCCACCACGGAGGAGG 2806. chr19_ZNF568_NM_198539_-1.62745
TCGGCGCTTTAGGCGTCTGTCACAGACCTATCTGCGGGTCGCCTTCACCC
AGCATCTCAGAAACTGCGCGCGGGATGAACATTCGGGTGTTTC 2807. chr19_ZNF585A_NM_152655_-1.66749
CACTGGGTCTCAACCCTTTTTCTGTAGGGTGTCTGAAGCTTGGCAGTCAT
CTGTGAACTCAAGCAGAGCTGCTCTGAAGAGATGGGCTGGAGTCTAGAGG
AAAATCTGGC 2808. chr19_DPF1_NM_004647_-1.98608
GGGTGAGACCCGCCCAGCTGGCACC 2809. chr19_RASGRP4_NM_170604_1.53752
AGCTGTCGCAGAAGGTAGGCTTTCGGAAGGTGACCTCATGGAAGGTGTGC
AGGAAGGCCAGGCCCAACTTGGAGCAGATGGCGCTGGCCCGGAGCAGGTA
CCCTGTCAG 2810. chr19_RASGRP4_NM_170604_-1.53031
GTCTTGCAAGAGTAGGGCTCAGCTCCTCCCCTTGCCCAGGACTCCAGCTT
CTCAGCCCCTAGGGAGCTGGGGCCTCCTCGGTGCTTGGGAAGGAAAGA 2811. chr19_RYR1_NM_000540_-2.09495
AGAGACAGGTGCCATGGTGTCCTCCA 2812. chr19_RYR1_NM_000540_-1.75739
GGTGACCGAGCTCCTGGCAGGCATGCCCGACCCCACCAGCGACGAGGTGC
ACGGCGAGCAGCCGGCCGGGCCGGGCGGAGACGCAGACGGCGAGGGTGCC
AGCGAGGGCGCTGGAGACGCCGCGGAGGGCGCTGGAGACGAGGAGGAGGC
GGTGCACGAGGCCGGGCCGGGCGGTGCCGACGGGGCGGTGGCCGTGACCG
ATGGGGGCCCCTTCCGGCCCGAAGGGGCTGGCGGTCTCGGGGACATGGGG
GACACGACGCCTGCGGAACCGCCCA

Figure 3-228

2813. chr19_RYR1_NM_000540_1.53354
CTGTTTCACATGTACGTGGGTGTCCGGGCTGGCGGAGGCATTGGGGACGA
GATCGAGGACCCCGCGGGTGACGAATACGAGCTCTACAGGGTGGTCTTCG
ACATCACCTTCTTCTTCTTCGTCATCGTCATCCTGTTGGCCA 2814. chr19_MAP4K1_NM_001042600_1.65275
GCTGGGAGCAGTAGGATCATCCACTGGGCGTGTCTCCA 2815. chr19_ACTN4_NM_004924_-1.5058
CTCTCTGCAGTCCTCCGGGGTGGGTGGGTGGGCAGGGAGGGGCTGGGGCA
GGCTCTCTCCTCTCTCTCTTTGTGGGTTGGCCAGGAGGTTCCCCCGACCA
GGTTGGGGAGACTTGGGGCCAGCGCTTCTGGTCTGGTAAATATGTATGAT
GTGTTGTGCTTTTTTAACCAAGGAGGGGCCAGTGGATTCCCACAGCACAA
CCGGTCCCTTCCATGCCCTGGGATGCCTCACCACACCCAGGTCTCTTCCT
TTGCTCTGAGGTCCCTTC 2816. chr19_CAPN12_NM_144691_1.51232
TGCCAGCCTCAGCTCGTAGGAGTTCATGGTTCCAGA 2817. chr19_CAPN12_NM_144691_1.94952
TGTGTGTGCCCGTGATGGAATACGCGTGTCCCTTTACCAGGCCCTCTTCT
GTGCGGTACTCACCCCCATCA 2818. chr19_LGALS4_NM_006149_1.53391
GGAAGGCCGAGAGGCGATGGGCAAAGTCAAAGAGGTGCTGGCCATTGGCG
TAAAC 2819. chr19_ECH1_NM_001398_-1.8016
GTTGAAGGTCTCCTGGTATCGAGTGATGATGTCACGGAGGTACCAGCTGA
TCCGGGCCACATCATCTCCTTTGGGCTGCAGGATGTCCGAAGCCATGTCC
AT 2820. chr19_FBXO27_NM_178820_1.86042
AGGCACGGTTGTCCTGTTTTCCTCCACCACCCAGCCGTCCCCACCGTGTT
GCACCATCCACTTTCGGAGGCCTT 2821. chr19_FCGBP_NM_003890_-1.51382
GTTTGGAGTCAACGTCACCATCCCATCCTGGAAGAAGATGTGGACCTGGC
CCACAGCCTCCGTTTTGCCATGGCAGATCTGGACTTCGGCAACTACACGG
TACCAGGGGATGGTATTCTGTAGTCCTGGGCAGCGGGAAGAGAGCTCATA
GACACCAGGAGAGGTGGTGGCACCACGGGCCCCATCAAAGGTGGTGAGGT
TGGCACCCACAGACAGGACACAGAGACCACGGGTGGCCCAGCAGTTCCGG
GCTTCAGCCTTGACCTCACATACACGGCCTGGTGGGCAGCCAGCTGCCTG
GCATGTCAGGCCAGAGCTTGAGGAAC 2822. chr19_ZNF546_NM_178544_-1.52126
TAGGGATGTGTCCATAGACCTCTCCCAAGAG 2823. chr19_MAP3K10_NM_002446_-1.53896
TGGAGGCAGCAGCGTGCCCCCTTCCCCCTACTCGACCCCGTCCTACCTCT
CAGTGCCACTGCCTGCCGAGCCCTCCCCGGGGGCGCGGGCGCCGTGGGAG
CCGACGCCGTCCGCGCCCCCCGCTCGGTGGGGACACGGCGCCCGGCGGCG
CTGCGACCTGGCGCTGCTAG 2824. chr19_AKT2_NM_001626_1.5717

Figure 3-229

TCACTGGGGCTTGTGTGGATTAAAACCTGAATCTCCAACCGCCCAACAGC
CCAGGCCTGGGCGGGAGGTGGAGTCTTCCAAATGCGAGTCTGGGCACAAA
GGTG 2825. chr19_PLD3_NM_001031696_-1.77241
CCTGCAGAGGAGCCCGCCAATGAGCTGCCCATGAATGAGATTGAGGCGTG
GAAGGCTGCGGAAAA 2826. chr19_PRX_NM_020956_-1.74361
ACCAGCTCCACCTCGGGGATCTTAAGCTGCACAGCGGTGGACTCAGCCTT 2827. chr19_BLVRB_NM_000713_-1.5655
TGTACGCCCCAGTTAGTGGCTGGTCTC 2828. chr19_SPTBN4_NM_020971_-1.73252
GCGGGCGCAGCGGGAACAGCGGGCGGCGCGCATGACCTGTCCAG 2829. chr19_LTBP4_NM_001042544_-1.69478
CGAATGCCGGAACCGGTCCTTCTGCGGTGCCCACGCCGTGTGCCAGAACC
TGCCCGGCT 2830. chr19_ADCK4_NM_024876_1.71184
AGGCCCATCCTGGTAAAACTTTTG 2831. chr19_C19orf54_NM_198476_1.5494
CTCTTCTCCAGGCCGAAGACATGACGGGGAGCAGGCC 2832. chr19_CYP2B7P1_NR_001278_1.59404
CCGGGGAAAAATCGTCATCATGGACCCAGTCTACCAGGGATATG 2833. chr19_CYP2S1_NM_030622__1.50459
CAGAAGAGTTCAACCCAGACCGTTTCCTGGATGCAGATGGACGGTTCAGG
AAGCATGAGGCGTTCCTGCCCTTCTC 2834. chr19_---_---_1.55297
ACAGCGCCCAGAGCCCGGATAGAGAGACACGGCCTCACTGGCTCAG 2835. chr19_AXL_NM_021913_1.50775
TGCCATCTGCACGAGGTCAGAGCTGGAGGATTTCCTGAGTGAAGCGGTCT
GCATGAAGGAATTTGACCATCCCAA 2836. chr19_TMEM91_NM_001098821_1.54112
GACAGCCCTAGTCTTCGTGAGCTTCAACAGCCTCTGCTGGAGGGCACAGA
ATGTGAGACCCCTGCCCAGAAGCCTGGCAGGCATGAGCTGGGGTCCCCCT
TAAGAGAGATAGCCTTTGCCGAGTCCCTGA 2837. chr19_EXOSC5_NM_020158_-1.84107
AGCTCTTGGAGTAACGCCTCTGCAGCGATTCCCGGTAGAAACGGAAGACG
TGTTGCGAAGC 2838. chr19_ATP5SL_NR_030765_-1.65332
GGCTGTGTCCCGAGGCTGCTCCTCC 2839. chr19_CEACAM5_NM_004363_1.5623
ATTTCCCCTCTAAACACATCTTACAG

Figure 3-230

2840. chr19_CEACAM3_D90278_-1.54331
CCTGTCCCAAGCAAACCTGGGCAGACCCAGCCTTGACCAAGAATAGGAGG
GGA 2841. chr19_ARHGEF1_NM_199002_-2.0426
CCGGACCGAGAGAATCCTCAGTGACCTCCTGCCCTTCTGCAGACCAGGCC
CCGAGGGCCAGCTCGCTGCCACGGCCCTTC 2842. chr19_GRIK5_NM_002088_1.76533
TTTAGCTCGATGGTCCTCCTCCTTGGGGCACCGGCCCCCCTCCCACCACT
TGCGCTTCAGGATCTCCAGCCGGTTGTTCTCCTGAAGCTGCAGGATGGCC
AGTGTGATCTCATCCCGGAACGGGG 2843. chr19_MEGF8_NM_001410_-1.50166
GCGCCTCCCAGTGGTCGGTACTCACATGTAGCTGCGGTGCTTGGTGGCAG
CGTCCTGTTGGTGGCTGGGGGGTACAGCGGCCGGCCCCGTGGGGACTTGA
TGGCGTACAAGGTGCCC 2844. chr19_XRCC1_NM_006297_1.75617
TGCTGTCCCGGGTCCAGTCTGGCCGATACTTGGCCCCAAGCTCTAGGGCC
TTATCTCGCAGCTCGGAGCGGAAGG 2845. chr19_CADM4_NM_145296_-1.5958
AGCTCCTTGCGGTCCCGGTACCAGCGCAGGGTGGCAGCCGGACGGGACCG
CGGAACGAGGCAGCTGAGCTCCACC 2846. chr19_CADM4_NM_145296_-1.61654
TAGTACCGTGAGCGTGGCAATCTGGTGGTGGGTGTCTTCTGTGTAGAGCT
GGCAGAAATAGCCCCCCTCGTCCTCCAGGCGGGCATCTGAGAGCCGGATC
CGCACCCGGCGTGGGGAGAACTCCTCAAGCTGGAAACGCTCATCCT 2847. chr19_ZNF45_NM_003425_1.55566
GTGCCAGAAAATTGGAGGCCCGACAGAAGCCCTTCCCACACTCCTCACAT
TGATAGGGTTTCTCTCCAGTGTGGCACCTCTGATGGGCTTGAAGCTGTGA
ACCTACACTGAAGCCCTTCCCACACTCTGCACACTGATATGGTTTCTCTC
CAGTGTGAACTCTCTGATGCACCTGAAGGCTGGAGAACTGACTGAAGGCC
TTACCACACCTCTCGCATTTATAGGGTTTCTCTCCTGTGTGGATTCTACA
GTGTACATTAAGATCTGAGCTCCGACTGAAGCCCTTCCCACATGTACCAC
ATTTGTAGGGTTTCTCTCCAGTGTGGCCTCTTTGATGGGCCAGAAGATTT
GAGGCCTGGCTGAAGCCCTTGCCACACTCCTCACATTTATAGGGTTTTTC
CCCTGTATGGACTCTAAAATGAATGTTAAAATCTGAGCTACGACTGAAGC
CCTTACCACATGCATCACACTGATACGGTTTCTCTCCAGTATGGCCTCTT
TGATGGTCCAGCAGATTTGAGGCCCGGC 2848. chr19_ZNF223_NM_013361_-1.53328
TTAACCAGGCCTCAAGACTCTACCATAAAGAGCTCTCAGTTCTTTGAACA
GGGTGATGCCCACTCCCAGGTTGAGGAAGGACTATCTATAATGCACACAG
GACAGAAACCTTCCAATTGTGGGAAGTGTAAACAATCCTTCAGTGATATG
TCCATCTTTGATCTTCCTCAGCAAATACGCTCAGCAGAGAAGTCTC 2849. chr19_CEACAM19_NM_001127893_-1.9218
GGGCCAGGGATCTCTGTCCATCTTGTGCTCGGCTGTATCCCCAGTGCCTT
CAGTGACGCCCAGCACATG

Figure 3-231

2850. chr19_APOE_NM_000041_1.5091
GCGCAGCCTGCAGCGGGAGACCCTGTCCCCGCCCCAGCCGTCCTCCTGGG
GTGGACCCTAGTTTAATAAAGATTCACCAAGT 2851. chr19_NKPD1_ENST00000317951_-1.6288
GCGCTGTTGGCCCGGTGGGCAGCGTGGGGGGTATCGCGGGTAGG 2852. chr19_MARK4_NM_031417_-1.71403
ACGACGGGCCGGAGGTGGACATCTGGAGCCTGGGAGTCATCCTGTACACC
CTCGTCAGCGGCTCCCTGCCCTTCGACGGGCACA 2853. chr19_PPP1R13L_NM_001142502_1.66173
AGAGACCAATGTTTCCCACCCAGACCCCAAGACTGCTGGGAGAGATGGTG
TCAGCAGTGACTCCCAGGAATATCCAGTGGTGTGGTGGCCCATCCCAGGC
CCGGCTGGGCAGGTGGCTGGCTTGCTGGGGGATGTGATGATGGTGGTAGG
CATGGGAGGCACTTTGGACGGGAT 2854. chr19_PPP1R13L_NM_001142502_-2.0965
AGGAGGCGCGGGAGAGTCTGACCACAGCGACTCCAG 2855. chr19_OPA3_NM_001017989_1.54883
GGGCGAACTGACGATGACTTAGGTAGTAAAGGGACAGGCCGGTCCCTAGC
AAAGGCAACTGAAGAGGACAGCGAGGGAGGACCGGATAAAAGGACAGTAG
CAGTAGGTCCAGGACTGGGGACTGGTGACCAAGTGACTGAGCCTGAAAGC
CAGAATGGACTAGCCCTGGTCAAGACCGGTTTTTCCTCCCAAAAGGCCAC
GTCCTGCTGGAACAGACCACAGAATGCCGGGCTGGGAGGCGTTTCCCTGG
AAGACCCAGCATAGCCATGCCAGTGGGGTGCGCCATAGGTGGAAGAAGAG
GGGGGTTATGTTGGATCGATCCACTCAGGGAGGGGAGGATGTCAATGACA
GGTACTAAGATGGATTAAGGTCAGGAGCCGCAGGGTGGTGACTCATTGGA
GCTAACGCAGTCCAGGATTCAC 2856. chr19_EML2_NM_012155_1.6142
CAGACCACCCGCCACTGTAGCACAC 2857. chr19_QPCTL_NM_017659_-1.79077
ATTGATCGGAAGCCTCCCCGAAGCCCGGCTGCGGAGGGTGGTGGGACAAC
TGGATCCACAGCGTCTCTGGAGCACTTATCTGCGCCCCCTGCTGGTTGTG
CGAACCCCGGGCAGCCCGGGAAATCTCCAAGTCAGA 2858. chr19_SIX5_NM_175875_-2.03722
AGGACCTGGGAGACGAGCATGCTGGTGGGGAAGGTGGCGGTGAGGATGAT
CTTGCCCTGCTGCAGGGCCACACCCGTCACGATGGGGCTGCCAG 2859. chr19_FOXA3_NM_004497_-2.21903
CCCGGCTATAAAGCGTGGCCGCCTCCCGCGGCGCTCGGGACAGCCGTACC
CCGGGCGGTCGGACGGGCGGGCGCCGGTGGGAGCTCGGGCCGTGCCCGCT
GAGAGATCCAGAGCGCTCCGTTCCC 2860. chr19_IRF2BP1_NM_015649_-1.62451
CGACACACGGCCTCGCTGAAGTCCCACACCATGGCCCACGGCATCTTGGG
CAGGTCGCACAGGTAGCACCACTGGCGGCGGGACGCCTGCACAGA 2861. chr19_HIF3A_AK299699_-1.54623
CCACCACGCCCGACAGTAAATATGTTTTGAA

Figure 3-232

2862. chr19_CCDC8_NM_032040_-2.00324
CTGGAGGTCTCGAAGTCGCTGAACTCGCTGTCGCTGGCGTTGCTGCTGTC
GTACGTGCCCACGACCAGCCGGGGCGGAGGAGTCACCATCTGCTGCACTC
TCCTCCTCACTCGGGGCTCCTTGGGCTTTTTGGGGGGCTGGGGCGGGTGC
GGGGTGCTCTTCTCCATGATGCGGGCCACGTCCTCCAGGGTGCGGCCCTC
TTCTTCCAGGAACTGGGTCAGCCGCTCCCGAAATTCTGCTTCCTTGGTGG
CGGGCTTAGAGATGACTCTCCAGACGCCCCCAGCCAGCCTGACCTCCCGG
GGGATGAGCAAATAGTCGACGTCCTCCCC 2863. chr19_PRKD2_NM_016457_2.25433
CAGTAGCGGTGGCGGCGACTGCAGC 2864. chr19_STRN4_NM_013403_-1.52208
CCTCCATGTCATACAAGACGGTGTCGCCAGAGCGGAAGGAGGCCACGATG
TGGGCAGGCTCGGTGCTGGTGAAGGCCACTGAGGTG 2865. chr19_BBC3_NM_001127240_-1.50654
CATTCCGGTATCTACAGCAGCGCATATACAGTATCTTACAGGCTGGGCCA
TCCCTCCCCACTCCCAGACTCCTCCCTCTTCCGAGATTTCCCCCCCTCCC
TGACTCCCCGTCTTCCCCCCAGCGCTTGGCCCTGGGGACTAAGGCTGGGG
CGGCTTCAGCCAAAATCTCCCACCCCCCAAATGAATGCCAGTGGTCACAC
GTGCTCTCTCTAAACCTATGCAATCGGATTGATCGCGCGGCCGGCCGTCA
CGGGCAGAGCACAGGATTCACAGTCTGGGCCCCTCCTGGCCACCCCCTGA
TGAAGGTGAGGCAGGCATGCCCACCACCCGCCGGCTGGCTCAGGGAAGAT
GGCTGGGCGCCGGGCTGGAGCAACCGGCAAACGAGCCCCACTCTCTGGCT
CCAGGAGGCTAGTGGTCACGTTTGGCTCATTTGCTCTTCACGGGC 2866. chr19_CCDC9_NM_015603_-1.54316
TGCGGTCGCAGAGGCCGACGGAGCCGGAGTCGCGGACGCCGC 2867. chr19_CCDC9_NM_015603_-1.77411
CTGCCCATGAACCATCCCACCGCTATG 2868. chr19_PRR24_NM_178511_2.06407
TGCCGTGCTGCTCGCCGTGTACTACGGTCTCATCTGG 2869. chr19_DHX34_NM_014681_-1.73727
CATGGTTGCTCACTCCCGTAATAAAAAAATA 2870. chr19_DHX34_D50924_1.7116
GCCCCATCAGAGGGGACGTGCTGGGTGT 2871. chr19_NAPA_NM_003827_1.55512
AGAGAGAGAAACCGGCCTCATGACTCAGCTGGTCAGGAGATAGGGGGCCA
GATGCTGACCCCAAATCCCCGGCAGCACCCCTAGCAAATAGGTCTGTATC
AAAGATTCTGTACAGCTGGTTTTGGGGGTGAAGGGCACCTATGGGGGCTT
AAATAAATGGACAGGGGGCAAGGGATGTAGCGAGAACAGAGGGTGACTGT
CCGGCCAGCAGCCTGGGCCTCTGGCGCCCCTGCATGCTGACCCCCGGTGC
CACCTGCCCACTGTGGCCCGCGGCACTCCCCAGATGGGAAAGGAGGGAAG
CTCTCCAGCAAG 2872. chr19_GLTSCR1_NM_015711_1.64555
CCCAGCCGCCTGAGGGACCGCTGCCC 2873. chr19_LIG1_NM_000234_1.65424

Figure 3-233

TTCCTGAATGGTCCGTTTCGGGAGCTGCT 2874. chr19_CCDC114_NM_144577_1.97674
TGGGCATGTAGGAAGGCCTGCACT 2875. chr19_CYTH2_NM_017457_1.59792
CTTGGTGGAGAATGAACTGCTGCAGAACACACCCGAGGAGATCGCCCGCT
TCCTGTACAAGGGCGAGGGGCTGAACAA 2876. chr19_CYTH2_NM_017457_1.61124
TTCTATGGAGCTTTCGCCTACCCGGAGAGGCCCAGAAAATTGACCGGATG
ATGGAGGCCTTCGCCCAGCGATACTGCCTGTGCAA 2877. chr19_SULT2B1_NM_004605_1.55662
GAAGAACCACTTCACGGTGGCCCAGAGCGAAGCCTTCGATCGTGCCTACC
GCAAGCAGATGCGGGGGATGCCGACCTTCCC 2878. chr19_SPHK2_NM_020126_1.57931
TGGGGCCGCCACCTACGAAGAGAACCGTGCCGAGGCCCAGCGCTGGGCCA
CTGCCCTCACCTGTCTGCTCCGAGGACTGCCACTGCCCGGGGAT 2879. chr19_FUT2_NM_000511_1.96182
CTCCGATGGGTAGGAATTGTCACATACCCATGTGACCCGATAGGAGGCAA
AAGAAATGAGACTTCTGGGATTAGTTTAGCCTCAGATTCTGCAGCTGAGA
AGTTGATCAGCCACCTCTGAAGGACATGCAGCTTGCAGAAAATTAGGGTG
GTGTTACCAAGGTGAAAAGGGGAAATGGCTTTAGAGTAGACAACAGAGAT
GCCCTGAGGGGTTGTGTAGGTTGTTCACTGCAGGAAGTCCCCTGGTTAAG
AAGGCAAGTGGGGTTTAAACAGACCCACAGTCTACTCATCAAACCAGGTG
TCCTTGGCATTGTGTCCACCCAGAGAGC 2880. chr19_PLEKHA4_NM_020904_-1.87589
TAGCCAGGGCTTGGGAGAGGCTGAGAACCCGCTCC 2881. chr19_PLEKHA4_NM_020904_1.60682
GAAGCCAGCCTCGGATGTGCACGGGAAGGTTGGGATCCCTCCTGAGCGCA
TTGCCTCTCTTCCCAAAGGCGTGGAT 2882. chr19_RUVBL2_NM_006666_-1.88431
ATCCGGGGCACCAGCTACCAGAGCCCTCACGGCATCCCCATAGACCTGCT
GGACCGGCTGCTTATCGTCTCCACCACC 2883. chr19_DKKL1_NM_014419_-2.15196
TGCCCCAAGCACCATATGGAAATAA 2884. chr19_ALDH16A1_NM_153329_1.71428
GGGCACTGTCTGGATCAACGCCCACGGCCTCAGAGACCCTTCGGTGCCCA
CAGGCGGCTGCAAGGAGAGTGGGTGTTCCTGGCACGG 2885. chr19_RCN3_NM_020650_1.50881
GCGGCTGAGCAAAGCGGAAATCCTGGGTAATTGGAACAT 2886. chr19_SCAF1_NM_021228_-2.02151
AGAAGATGAGTCTCGAGGGAAGACAGAGGAGTCGGGGGAGGATCGGGGCG
ATGGTCCGCCAGACAGAGACCCCA

Figure 3-234

2887. chr19_SCAF1_NM_021228_1.56263
GGCTTGTCGGGAAGGCAAGGTCTCGGTGGAGGTGGTGACCGCTGGTGGAG
CCGCCCTCCCGCCGCCCCTGCTGCCGCCCGGCGACTCGGAGATCGA 2888. chr19_CPT1C_NM_152359_2.06268
ACTTCCTGTATGTCACACCCACGCCTCTGCAG 2889. chr19_PTOV1_NM_017432_-1.5233
TCCTACAAAGCATCGTGTGAGATCCGCGTGCTTATG 2890. chr19_PNKP_NM_007254_-1.58043
GTGTTGTCGATGGCGACCCGTTTCCCTTGCTTCAGGGCTGTCTCACACGT
GGTCACACAGCGCTG 2891. chr19_AKT1S1_NM_032375_1.58855
TCATCTGATGACCGCGCCTCTGTCCTCTTCTCCTTGAAGCCCCAGACGGG
CACAGACACAGGCAGGGACTTGGCGTACTGCTGTGTGGGTAGGGCT 2892. chr19_TBC1D17_NM_024682_-2.29864
GGGCCTACCTGGTTCTGGTGACCCAGGCTGGAGGTTCCCTGCCCGCACTG
CACTTCCACCGCGGGGGCACCCGCGCCCTGCTCCGCGTCCTCAGCCGCTA
CCTGC 2893. chr19_MYH14_NM_001077186_1.76583
GAAGGCAGCTGTACTTCGGGCAGTGGAGGAACGTGAGCGGGCCGAGGCAG
AGGGCCGGGAGCGTGAGGCTCGGGCCCTGTCACTGACACGGGCA 2894. chr19_POLD1_NM_002691_-1.76563
CTCCGCGCCTTCGGGGTCACCGATGAGGGGTTCTCTGTCTGCTGCCACAT
CCACGGCTTCGCTCCCTACTTCTACA 2895. chr19_POLD1_NM_002691_-1.71864
ATCAGGACCCCCACCGGGGACGAGTTTGTGAAGACCTCAGTGCGGAAGGG
GCTGCTG 2896. chr19_SYT3_NM_032298_-1.64916
TGCCAGTGCTCCACGGGCTTGCGGGGATTGGCCAGCATCTCTGCCCAGTG
CTCGCGGCCGTGCGGGTCGGCAGCGTCGGGGCCCACACGGCACACGCCGA
TCACCTCGTTGTGCCCGATG 2897. chr19_SHANK1_NM_016148_1.54542
GGCGGGGGAATGTCCTCCGAACCAGGCACAGACAGGCTGCGGCTGAATTT
CATGGCTGGGGGTGCTAGGTAAGGTCTGTCATCT 2898. chr19_SHANK1_NM_016148_-1.64396
GATTTTTGCCGGAGCATCAACCCAGGTCCTGGAGGCAGGAAAGAAGGACG
CTCGTAACTTGGCTGGGCA 2899. chr19_SHANK1_NM_016148_1.72824
TGTAAACTCGGGTCTTGTATCGGAA 2900. chr19_KLK1_NM_002257_-1.5498
GTGCTGAAATGGTACAGAGCCGCCTGCCAGGGCTGGGAATGCTGCTCACA
CTCCCAGCCTCCCACAATCCGGGACTGAATCGGGGGC

Figure 3-235

2901. chr19_KLK12_NM_019598_-1.56537
CAGCGGTTGCACAGTCATTGGGCAGGGGCAGGGGTTGAACGCTGCTGGTT
ACGCGGACGGGCAGGCGCAGCCGCAGCAGCCGGAGGTCGTGCTCGTGGCT
CGTCGAGGCTCCCAGGTAGCCGGGATGGGTCACAGAGAAGCCGCTGTGCC
GGATCTGCTCGGTCCAGTCGAGCTGGCTGA 2902. chr19_CD33_NM_001772_-1.73972
GGGCAGGAATGACACCCACCCTACCACAGGGTCAGCCTC 2903. chr19_SIGLEC12_NM_053003_1.50856
ATCGACCGTGGGTATCCTCTTGCACTTTTCCACTTGGGGTGTTTGTGGCC
ACTGGAATATCCCATGGTATATCGGCCCCTTCCTTGAACCAGGATCCATA
AACAGGGCTAGAGGCAGTCCAGTTGTAATGGGGGTAAAGGACACTGCAGG
GCACAGAGACACACAGACCCTCCTGCACAGTCACCGACTCTGGCACCTCC
AGCCTGTATCTTGACAGTAGGTCCTGG 2904. chr19_ZNF701_NM_001172655_-1.68737
GAGTAGTACAGAGCGACATGATCA 2905. chr19_ZNF702P_NR_003578_-1.53927
ACACTACTGCTAACATGGCCAAGCACATGGATGCTCCAGCATTTTCTCAG
CTTCCTGCTTTGTTTTCTTGATCTGTCCCCATGTTATGGGGGTGGATGTC
AGTGTGACTCCAGTCGGCCCTTGCTCCATCTTTGCATTCAAATTCAGCTG
GCTCACGACTCCTACTGGAGGGACCAGGTCCACGGTTGGCCAACGTGGGT
CCTGCTAGTCTCCCATTTCAT 2906. chr19_PRKCG_NM_002739_-1.60407
TGAACGTGCACCGGCGCTGTGTGCGTAGC 2907. chr19_TMC4_NM_001145303_1.85257
GCGCGCCGTGCCAGGAAGACTTTATTCT 2908. chr19_TSEN34_NM_024075_-1.52351
TAAGGTGGTCTACACCTCCCTGCAATGG 2909. chr19_LILRA5_NM_021250_-1.67137
CAAGGTCCAGGAGAGCTTGTGGTCTCCTTCCTCAGTCAGAATGAACCTGT
CGAATCTCAGCCGTGAGCCACACTG 2910. chr19_TTYH1_NM_020659_-1.54125
AATCCAAGCGCTTTGTGCAGTGGC 2911. chr19_CDC42EP5_NM_145057_1.50916
TAGAGGCCGATGACGTCGTTCAGCTCGAGGTCCGCGTTGGGGCGGCAGCG
GGCCTGGGGGGGCTGCGTCCCGGGGCGGGGTTCCGCGTCGGGCTTGGCGG
CAGCCGCCTCCGGGCGCGCCGCGTCCATGACGCCCAGCACCGCGTCCAGC
AT 2912. chr19_LILRB4_NM_006847_1.61288
CTCACCCACAAGGTCCGTCTCAACA 2913. chr19_NCR1_NM_004829_1.53593
GGTTCATCCTGGACCCGAAGTGATCTCGGGAGAGAAGGTGACCTTCTACT
GCCGTCTAGACACTGCAACAAGCATGTTCTTACTGCTCAAGGAGGGAAGA
TCCAGCCACGTACAGCGCGGATACG

Figure 3-236

2914. chr19_GP6_NM_001083899_-1.73151
ATAACCCGCGGCTGTGAACATCCTGTCGGCCTCCATC 2915. chr19_RDH13_NM_001145971_1.72752
AGGTGGAGCCATGGATGCCCGTGTGTCTGCCCAGCTCTGTCCTGGCCACG
CCGGGGTGCAGGGCGTTGACAGTCACACCAGAGC 2916. chr19_C19orf51_NM_178837_1.7788
GTCAGGCCCTCAAGGGCTGGGTTGCTGGCTTCAAGAGGCTGGGCCAGGAT
GTCAAGGGGCGGAGTTCCGGGTTCCACAGCTGGGAC 2917. chr19_PTPRH_NM_002842_1.88347
TCAACGGCCGACTCTCTCTCATCTTCCTTACAAAGCTGAAGGGCCCAAGG
AGACCCTCGGACTGCAGCTGCCGGAGCAGGACGTCCAGGGCAATGAGGGT
TCCTGTGCGACCCACG 2918. chr19_BRSK1_NM_032430_-1.51845
CCCAGCCGTCGGTTCAAGCGAGTGGTGGAGACCATCCAGGCACAGCTCCT
GAGCACTCATGACCAGCCCTCCGTGCAGGCC 2919. chr19_SUV420H2_NM_032701_1.52579
CAGCATCATGTACTCAACCCGCAAGCGGAGTGCTCAGCTGTG 2920. chr19_COX6B2_NM_144613_1.66707
AAGCGCGGGTCGAAGGGCGGCGTCGACCATTTCC 2921. chr19_SHISA7_NM_001145176_1.73958
GGTCCCAGAGTGGGTGGTCATCTCTGGTGATGA 2922. chr19_U2AF2_NM_007279_1.6513
AAACCTTTGACCAGAGGCGCTAAAGAGGAGCACGGTGGACTGAT 2923. chr19_ZNF551_NM_138347_-2.55324
ATGGAGAATGAGGCGATAGCTTCT 2924. chr19_ZNF154_NM_001085384_-1.64536
CTGGAGCTGTAGGGAAAGAACTTCCCACATTCACTGCACTCATAAGGCCT
CTCCCCAGTGTGAACTCCCCGATGTTGAAGGAGTGCAGACCTTTGGCTAA
AGGATTTCCCACATTCGCTGCACTTATAAGGCCTTTCTCCAGTGTGAACC
CTATGGTGTTCAATGAGGCTAGAGTTTTGGCTAAATGACTTCCCACATTC
GCTGCACTCATAAGGCCTGGATCCACTGTGAACTTTCTGGTGTTTTATGA
GACTGGAATGATATGTAAAAAACTTCCCACATTCACTGCACTCATAAGGC
CTCTCCCCAGTGTGAACTCCCCGATGTTGAAGGAGTGCAGACCTTTGGCT
AAAGGATTTCCCACATTCACTGCACTCATATGGCCTTTCCCCAGTGTGAA
CTCTCCGATGTTTAATGAGGTTAGACTTGTTGCTAAATAATTTTCCACAT
TCATCACATTCATGAGGTCGTACTGCAGTGTGAACTCTCCGGTGCTGAAT
GAGACTAGAGCTTTGCCTAAAGGACTTCCCACACTCTCGACATTCATAAG
GCTTTTCTCCAGTGTGAAGTCTCCAATGGTCATTGAGACTGTAGCTTTTG
CTAAAGGATTTCCCACATTCACTGCATATGTAACATCTTTCTGTAGTGAG
GGTTCTCTGCTGCTGAACAAGTGTGTGTTTACCGCTGAATGCTTTTGTGT
CTTCTCCACAGTTGTAATGAGTTTTTCCTCTGTGACTGATGGCCCCACCG
TCGCTTTTGCTATTTGATTGCTCCCCAGTGTGAGCAGCCTGTTGATGGAG
AAATCCCAACTTGGCCAGGAAGTCCTTCCCAACTTCTCTGCAGGTGGAAG
GCTCCCCTGACACATGGAATGTGCAGGTCTTCACAAACAAGGCTCTGCCC

Figure 3-237

ACATTGCTTCTGAAATGTTTTTCTCCAAGGTGCTGCTTCTGATGATGAAC 2925. chr19_ZSCAN18_NM_001145542_-1.84156
TTCCCGCGGGACAAGCCCGGCTCGTCAGCCCCA 2926. chr19_ZNF274_NM_016325_-1.71033
ACCCCGGAAGAGTGGGGACTGCTGGACCTCAAACAGA 2927. chr19_ZNF274_NM_016325_-1.64252
ACAGAGGACCGAGTACCGCGATGTGAT 2928. chr19_ZNF8_NM_021089_-1.69066
TCACGCAAGGAAGAGGGCCTGCCTGAAGAGGAGCCATCCCATGTCACGGG
AAGGGAAGGATTCCCGACAGATGCTCCTTATCCCA 2929. chr19_ZNF446_NM_017908_1.67224
ACTTGCAGCACAGTCCCCTGAGGGGAACCATGGACACCAAGAACCAGCCT
CCACATCCT 2930. chr19_ZNF446_NM_017908_-1.61837
GGCTTCGACTGGAAGTCAGTGTTCGTCATCCACCACCGGACACACACGAG
TGGGCCAGGTGTGCAGTCCCCGGGGCTAGCCACCGGGGAAAGCACAGAGA
A 2931. chr20_C20orf96_NM_153269_1.55122
AATCAGAAATTCCCACCTGGCCCAGCAGCACCAACCAGAAAGAAGGGAAG
AAGAGAGGAAAAAACCACAGGAAGAAAGAAAGGAGGGAGGGAGGGAGAGG
AGGAAGGAAGGAGGAGGGAAGGGAAGGGGGGAAGAAGGGAGGGAGGGAGG
GAGGGAAAGAAAGAGGGAGGAAGGGCAGAGGGAGCAGGGAGACTGTAGAT
CAGGGTCTGAATGGAGATCCGGTCCTGGAAGTAAATGATCCAAGGCTCCA
GGTGCTGGGA 2932. chr20_NRSN2_NM_024958_1.60197
ACATGGCCTAAGATGTGGGTCCTGGATCCTTCCCCCCTTCTCACCATAAC
CCCCTCTCA 2933. chr20_SDCBP2_NM_080489_-1.58249
ACCACGACAATCTTATCGCCTGATGCCTTCTTCACCACCTGATGGGCTTT
GTGCGAGCTCCACCCAGCACAGTCACGCCCGTCAATCTGCAGG 2934. chr20_SDCBP2_NM_080489_1.90367
CTTGGTCCACTTTTAGGTCCTCTAGAGATGGGTACAGG 2935. chr20_TGM6_NM_198994_-1.69947
CAGCAACAACGACCGAGGTGTGGTGCAAGGACAGTGGCAGGGCAAGTACG
GCGGCGGCACCAGCCCGCTGCACTGGCGCGGCAGCGTGGCCATTCTGCAG
AAGTGGCTCAAGGGCAGGTACAAGCCAGTCAAGTACGGCCAGTGCTGGGT
CTTCGCCGGAGTCCTGTGCACA 2936. chr20_SNRPB_NM_198216_-1.99303
TAGGGCCTTGGTGGGCGCATTCCCGG 2937. chr20_IDH3B_NM_006899_1.55368
CCTTCATGGAACTCAGCACCTGCT

Figure 3-238

2938. chr20_OXT_NM_000915_-1.54708
AGCCTCGCTTGCTGTCTGCTCGGCCTCCTGGCGCTGACCTCCGCCTGCTA
CATCCAGAACTGCCCCCTGGGAGGCAAGAGGGCCGCGCCGGACCTCGACG
TGCGCAAG 2939. chr20_HSPA12B_NM_052970_-1.52888
CGGCCAACGAGCTGCGGGCCCGGGATCGCGGCGGCTGGACGGGGC 2940. chr20_ADRA1D_NM_000678_1.68894
AAATATCGGTCTCCCGTAGGTTGCTGTAGTCGGCCAATTCGTAGGCCTGG
CAGGTGGCGCCCTCGGCCACCTCGTGTGGGACG 2941. chr20_RASSF2_NM_014737_-1.78082
TGAATGAAGCTTTTAAGTACCGGCATCTCGAACTTTATATACTG 2942. chr20_RASSF2_NM_014737_-1.64645
GAATGCGTTCGTTGTCATCCTGCATCTGCAGGCGAATGGGCCGGCGCAGG
CCCCAGGAGATGTTCAGGAGCCCCTCCACAATGAACTCGT 2943. chr20_C20orf7_NM_024120_1.64578
GAGGTTCCGCAACTGTGTCATTTGG 2944. chr20_PCSK2_NM_002594_1.53051
TGGGAGCTGGGATACACAGGGAAAGGTGTTACCATTGGAATTATGGATG 2945. chr20_MGC44328_BC033985_1.50122
CTGAGGCATTCTTGGGCCACATAGCAGTTGACTGCCCTCTCCACCATCTT
TTCACAAGTGTTAATCCCAATAAACACCCATCCTCTTC 2946. chr20_C20orf12_NM_001099407_1.64146
CCAGTAAAGTGGCGGTGCTCTCTCTTCCT 2947. chr20_SEC23B_NM_006363_-1.86575
CATCATGATCCAGCCCATTCTCTA 2948. chr20_SLC24A3_NM_020689_-1.65097
TGTTCGGCGTCCACCTGAACAAGTGGCAGCTG 2949. chr20_RIN2_NM_018993_1.62771
AGCAGAGGGCGGTGCAAAGACCTTGAGCGGCGGCCGGCC 2950. chr20_CRNKL1_NM_016652_1.63089
CCTCCTTGCGGCAGCGCGTGGAGTGCGGCGTCCTGGAGCTGCGGATGAGG
TGGGTAACGCCGTGCTGACTAGCAGCGACGCAAGGA 2951. chr20_NKX2-2_NM_002509_-1.53119
ACTGAAGGCCCTCGGTGCTGGCCAGCCAGCGCGTGTACGGGTTGTCGCTG
CTGTCGTAGAAGGGGTTCTTCAGGGGCAGGCTCTGCACCGCGTCCAGGGC
GCCCTGCCCCAGCGGCCCGGCCCTCTTGGCTGGCTCGGGCCCCTCGTTCT
CTTCCTCCGGACCTTCGGCCACAGAGCCCTCCTCATCGTTGGTGTCC 2952. chr20_CST8_NM_005492_-1.71703
TGCCGGTGGCTCTCCCTGATCCTCCTCACCATTCCCCTGGCCCTGGTGGC
CAGGAAAGACCCAAAAAAGAATGAGACAGGGGTGCTGAGGAAATTAAAAC
CCGTCAATGCCTCAAAT

Figure 3-239

2953. chr20_PYGB_NM_002862_1.5954
CCTGCGCAGGATGTCTGTGATCGAGGAGGGGGACTGCAAGCGGATCAACA
TGGCCCACCTGTGTGTGATTGGGTCCCATGCTGTCAATGGTGTGGCGAGG
ATCCACTCGGAGATCGTGAAACAGTC 2954. chr20_ABHD12_NM_001042472_1.88953
GGCACCACCGGGTCGTCCTCAGCGTGCAGGATGAGCAGGGGAC 2955. chr20_GINS1_AK294593_-1.86833
TATATGAGGTCACTGGGAGGAGAT 2956. chr20_NINL_NM_025176_1.50748
GGTAATGAGACCAAGCCTTGCTCGGTTTAACCCGAGTGGAAGACTCTAGA
AGTAGCGCGGGCTCATGACTGAAGAGGCCAAGCTGGAATTCCTCAAGACT
CACTTTGCCG 2957. chr20_HM13_NM_030789_-1.54943
TGGAGTCGGATCCCGAACGCACCCTCGCC 2958. chr20_HM13_NM_178580_1.82886
AGCTAGCTGGCCCTCGCCGCCGGCGC 2959. chr20_DUSP15_NM_080611_1.64366
GGAAATGGTGGTGGAGCCGCCGCTG 2960. chr20_TSPYL3_NR_002781_1.66159
GGCGCCCTCCTCCTTGTTCGCGTCCTCGGC 2961. chr20_DNMT3B_NM_006892_1.53587
CTTCTTCACCAGTGACACGGGGCTTGAATAT 2962. chr20_BPIL1_NM_025227_2.21424
GAAGCTTCAGGGGACCACGTCTGT 2963. chr20_BPIL3_NM_174897_-2.71704
ATGCTCCCCAAGATGGTCAACAAG 2964. chr20_BASE_NR_026760_-1.70416
TGCTGAATGTCTCCGGCCTCTTTGTTCTCCT 2965. chr20_NECAB3_NM_031231_-1.78152
CGGGCGCGAGCTGGGGGTGCCGCG 2966. chr20_AHCY_NM_000687_1.67789
TGATGCGGCGCCCATTCTTCAACCGATACCGGTCCAC 2967. chr20_CEP250_NM_007186_1.56152
CAAACAGTCAGAATCACTCAGTGAACTGATCACTCTTCGGGAAGCCCTGG
AGTCAAGTCACCTGGAAGGGGAGTTACTGAGGCAAGAGCAAACGGAAGTG
ACCGCAGCGCTGGC 2968. chr20_CEP250_NM_007186_-1.79376
GGCGAGAAATGCTTTGCAGGTCGACCTGGCGGAGGCAGAGAAGAGGAGGG
AAGCCCTGTGGGAAAAGAACACTCACCTGGAGGCTCA

Figure 3-240

2969. chr20_EPB41L1_NM_012156_1.71145
GGAGGGAGTTCATAGCAACCACTCCCTCCATCACCACGGAGACCATATCG
ACCACCATG 2970. chr20_EPB41L1_NM_012156_-1.59478
CTGCTTGTGCCAGGGACTATTCTCAGGCTGAAGAAGGTGGGAGGGGAGGG
CGGAACCTGAGGAGCCACCTGAG 2971. chr20_DLGAP4_NM_014902_-1.52501
GCCTAGTGGCGTATAAGAAGACCCCGCCACCGGTCCCTCCACGCACCACT
TCAAAGCCGTTCATCTCAGTCACAGTCCAGAGCAGTAC 2972. chr20_MYL9_NM_006097_-1.78265
GGCCCAGTTCCACGCACCCAGCGAGCCCAAGCGCCTTCTCCGCACCAG 2973. chr20_SLA2_NM_032214_-1.68138
GCGGTGAGATGTACAGCCAGCCATTGTCAAGGCAGTGGATCCTGTAGTGT
CTGATCCGGTCCCAGGATGCAGGGCGGCTGAGGCGGACTGACAGAGAGTA
A 2974. chr20_SLA2_NM_032214_-1.71325
ATGGGAGACTTTGGCCACGTGGACGCTGGGGATGTTATACTCTCTGCCTG
AGACTTCAGACAGCACCGTCCACCAGTCTCCA 2975. chr20_C20orf117_NM_080627_-1.77835
GGTCGGGCTTAGAGTCCAAGTCACCAGTGCGGAAAGCCTCTCGGATCCTG
GGCTCCCATTCCGGCAGGTCCCTGAAGTCA 2976. chr20_VSTM2L_NM_080607_1.53014
TCCTGGCGAGTCCTTCCTGTTCAGCTCCCTGTGCGACCCTCCAGGGATGC
AGGGGATCCAGGATTCTCTGCCCTGTCACACGGCGAGTCAGAAGGGAGGG
GCCTTTCCCTCGGACCCATGGCCCCAGGCAGAGTTTTGCACCAGCAGGAC
C 2977. chr20_TGM2_NM_004613_-1.7682
GGCCAATGATGACATTCCGGAAGCCCTTCACAGCCTTCAGCTTGTCGCTC
TCGAAGTTCACCACCAGCTTGTGGAGGCCCATGTGGAGCGGCA 2978. chr20_PLCG1_NM_002660_-1.60742
AGAACAGTGTGTGGAACTCGCAGCTGGATGCAGTATGCCCGGACACCATG
AACAACCCTCTTTCCCACTACTGGATCTCCTCCTCG 2979. chr20_PLCG1_NM_002660_1.52742
CCAAGAAGGACTCGGGTCAATGGAGACAACCGCCTCTAG 2980. chr20_ZHX3_NM_015035_-1.55953
GCAGGGAAGGTGCCTAGAGTCCCCAC 2981. chr20_PTPRT_NM_133170_1.56486
CGGGGTCACCTGGGCGCTGCCCAT 2982. chr20_PTPRT_NM_133170_-1.50314
TCGTGTGAGGAGCACTCGGATCTCATACTCAACATCGGGGTCCAGATGCC
ACAGCTTATAGTTGGGAGAGTCGACTATGTGGGTCTCTGCCCACGTGCCT

Figure 3-241

GTGGTGGTGCGATATTCCACTTCCTTCAGGATGATGGGGCCATCCCCGAT
GATGGAGTTGGCATTTGGCTTGATCCACAGGTAT 2983. chr20_SGK2_NM_016276_1.55274
TGCAGGGGTTGCTTACCTCGGGTAGGAAACCCTCAGGCGGTGGCA 2984. chr20_WISP2_NM_003881_1.71146
GGGGGAGCCCTGCGACCAACTCCACGTCTGCGACGCCAGCCAGGGCCTGG
TCTGCCAGCCCGGGG 2985. chr20_PI3_NM_002638_-1.86552
AGGCCCCATCTGGTCCTAAGTCCCTGCTGCCCTTCCCCTTCCCACACTGT
CCATTCTTCCTCCCATTCAGGATGCCCACGGCTGGAGCTG 2986. chr20_SEMG1_NM_003007_-1.56968
CCGTGTAGTTTCAGATTCTTGGTCCATGGATGACACCACCTGCCCATGCT
TCCTTGAATTAGGCTTTCCTAACCTGAAGCGCCTTCAAACTTCCAATA 2987. chr20_SNX21_AF258570_-1.50761
GTGGGGAGGTACAGCTGGGAGTGTGGGGGATGGGGAAGGATGGGGAGGGA
ACGGGCCCGTGGACAACTTGCATTTGCCCTGACACCCA 2988. chr20_PCIF1_NM_022104_1.97923
ACCCTTTGGGGCTGAATGCGACCCCACTGCCCCAAGACTCAAGCTTGGTG
GAAACTCCCCCGGCTGAGAACAAGCCCAGAAAGCGGCAGCTCTCGGAAGA
GCAGCCAAGCGGCAATGGTGT 2989. chr20_ZNF335_NM_022095_-1.79686
AGCTGCTTGCGTGTCGGCACCGTAC 2990. chr20_CDH22_NM_021248_-1.62363
GGACAGCTCCAGAGTCGGGGAAGCGCCATGGTTCCTGCGCAGAAAGGATG
CGGGTTGGGGCCGGCAGATCCTGCCAGGA 2991. chr20_SLC35C2_NM_173179_-1.90441
TGGAGGGATATTCCCGAGAGGCAGAG 2992. chr20_EYA2_NM_005244_-1.58862
TGGTCACCACCACTCAACTAATTCCTGCCCTGGCCAAAGTCCTGCTATAT
GGCCTGGGGTCTGTGTTTCCTATT 2993. chr20_STAU1_NM_017454_-1.66248
ACCATTTATTGATGACAAACACTT 2994. chr20_B4GALT5_NM_004776_1.6692
GCTCGGGTGTCAGGTTGACAGTTATGTTTTTATACAAGGCGTCGTATGTG
ATGTTTGCAAAGTAGTTCAGGTTGTTGAGGCCATCCAGCCCTTGCCGTTC
TTTTGA 2995. chr20_TMEM189_NM_199129_-1.60107
CGCAGCCAGCTCGCGGGCCCCGGCGTGCTGCGCGCCCCAGCGGCAACAAG
ACGCCTCGTCCTCGTCCA 2996. chr20_DOK5_NM_018431_1.60355
ATGGCGAATGTGCCTTGCAGATTACATATGAGTATATCTGTCTTTGGGAC

Figure 3-242

GTCCAGAATCCCAGAGTCAAACTCATCTCTTGGCCGCTAAGCGCCCTGCG
GCGGTATGGACGTGATACTAC 2997. chr20_PMEPA1_NM_020182_1.60121
AACAAAGAGCGTTTGCAGTTGCACGTGCAGGAGACATTGGGCTGCCCGGC
GGCGGCGGCGGCGGTGCTGTTGACCCCCATCAAGCGGTGCAT 2998. chr20_PMEPA1_NM_199171_1.63228
AGACCAGAGCGAATTCATCCTGAAGAACTCAGAGAAAGCCGGTGCAGGAA
GTGGGTTCCCGCTCTCCCTGCACAGGCACAGTGATGCTGCCAGAGCTCTC
CCAGAAAGACCAGGAGGCTTGTTCTGGAGAAGTCAAGCCCAG 2999. chr20_ANKRD60_ENST00000457363_-1.72117
CTATCCGGTGGAGGAGGACCATCTGCCTCTCGCTCAGTGTGTGGTTCAGG
CGGTGTGCAATGGAGATGGGGGTCTCCCCCTTGGCATCTCTGTCGTGGAT
GGAGGCCCCGTGCTGGAGCAGGAGGATTATACAGTCTGACCGGCCCAT 3000. chr20_STX16_NM_001001433_1.79353
TACAATAAAGCAATCACGCAGATT 3001. chr20_NPEPL1_NM_024663_1.70784
GCTTAGCGAATGCCACAGACGGCGTGCGGCTAGCAGCCCGCATCGTGGAC
ACACCCTGCAATGAGATG 3002. chr20_NPEPL1_NM_024663_-1.83018
TGCCGGGGATGAAGCGAGACTGCGGG 3003. chr20_TH1L_NM_198976_-1.59108
CAGAACATTCCAGAACCCGTTGTGGAAAAAACCCTTTCAAGAAGCTGTTTT
AAGAGGCTCGGGCAGCGTCTTGAAAATGGGCACCGCTGGGAG 3004. chr20_CDH26_NM_177980_1.52102
TGGAACAGGAGTTGCAACCTGATTTGCTGGACTCTTTGGGTTCAAAAGCG
ACTCCGTTTGAGGAAATATATTC 3005. chr20_CDH4_NM_001794_-1.74629
GTACACAGTCATCGTTCAGGCCACAGATATGGAAGGAAATCTCAACTATG
GCCTCTCAAACACAGCCACAGCCATCATCACGGTGACAGATGTGAATGAC
AACCCGCCAGAATTTACCGCCAGCA 3006. chr20_SS18L1_NM_198935_1.73425
GCGCAGCCGGAGTATCCACCTCGATGACCACGGGCTGAG 3007. chr20_LAMA5_NM_005560_-1.62141
TGTGGCGTCCACTGCCCGGTTCAAAGCCTCTCGCAGGTCCATGAGGCCGG
CCTCGTGCTGGGCCAGCCGGTCGCGGGTTTGTGTGGCCAGTGCCT 3008. chr20_LAMA5_NM_005560_-1.64973
GGCCGCCTAGCCGCCGTGCGTCCTGCCCGAGGCTTGT 3009. chr20_LAMA5_NM_005560_-1.80768
GCCACACGCGGCCGGCGTTGATGAGGACTTCCACGGGGAAGGTGGGGTGG
GCTGGCTGGTAGCCGTGCAGCAGGAAGGCATAGCGGCCCAGCGTGGGCAC
ATGGGTGGTGAAGACCACGGTGGC

Figure 3-243

3010. chr20_LAMA5_NM_005560_-1.57872
GAAGTGAAAGTAGCCGGGGGCACAGCGATCACATGTGGCCCCCTCGAAGC
CCACTCGGCACCTGCACTGGCCTGTGTCAGGGTCACAGCGGTCATCGGCC
ACTCCAGGGCT 3011. chr20_SLC17A9_NM_022082_1.66355
TGCAGCCACCCCCAGACGAGGCCCGCAGGGACATGGCCGGGGACACCCAG
TG 3012. chr20_COL20A1_NM_020882_-1.60443
CGCCGCCTCCACGGAGCTGCACAACCTGGCCTCCCGCACAGAGTACCTGG
TCTCCGTGTTCCCCATCTATGA 3013. chr20_KCNQ2_NM_172107_-1.65418
GCTGACTTTGAGGCCCGGGGTCAGGTCCTCGGTCACAAACTCGCAGGGGC
AGCTCTTGTCATCCACAATGTCCTCTCCGGGGAGGCTT 3014. chr20_KCNQ2_NM_172107_-1.6123
TAGAGCGTCCGGGGCAGCATCCACA 3015. chr20_PRIC285_NM_001037335_-1.51146
CGTGCAGCAGCTTCCGTAGCGCAGCCGGGGGCAGGTTCTCGTACAGCCGG
GCCTGCTGCAGGGACTCGGGCCTGGCGACAGTGTCCAGCAGCCCGTCCTC
CCCGACGGTCACCATCACCTTCTGGCTCTCGTCCAGAAGCTCCCGTAGGA
T 3016. chr20_GMEB2_NM_012384_1.5036
CCGTTCATGCGGATGGCTCTCTTCCAGTCCTTCAGGGTGGACTTCCCGGC
CAGGTGCACAAATTCCTTTGGGCTGATTACATGCTCGTCGT 3017. chr20_RTEL1_NM_016434_1.64624
GCGAGAACACCTCCGAGACGGCATCTCTGCCCCGCAAGATTGCCGAGAGGG
CGCAAGGAGAGCTTTTCCCGGATCGGGCCTTGTCA 3018. chr20_RTEL1_NM_016434_-1.73565
CCATCGGGCGAGTGATCCGGCACCGCCAGGACTACGGAG 3019. chr20_RTEL1_NM_016434_-1.5622
AGAAGATGCTGTCAGCGAGGCCAAGTCGCCTGGC 3020. chr20_RTEL1_NM_032957_1.77706
TCATGGGAGAGACATCGCTGGGCAGCAGGCCACGGGAGCTCCGGGCGGGC
CCCTCTCAGCAGGCTGTGTGTGCCAGGGCTGTGGGGCAGAGGACGTGGTG
CCCTTCCAGTGCCCTGCCTGTGACTTCCAGCGCTGCCAAGCCTGCTGGCA
ACGGCACCTTC 3021. chr20_ZGPAT_NM_032527_-2.07489
ACCATGCCAGCAAGAGTGCCAAGCGGGCCCTGAGCCTGCGGCTCTTCCAG
ACTGAGGAGAAGATCGAGCGAACCCAGCGGGACATCAGGAGCATCCAGGA
GGCTCTCGCCCGCAACG 3022. chr20_SLC2A4RG_NM_020062_-1.6397
GACCTGGCCAGTGACCAGTCCTCTCCGTCCACC 3023. chr20_DNAJC5_NM_025219_-1.50814

Figure 3-244

TTTGTCTTCTGCGGCCTCCTCACGTGCTGCTACTGCTGC 3024. chr20_UCKL1_BC033078_-1.65358
TGTGGGGCCAACAGTTGAGCGGGAGCACGCGCCCGGG 3025. chr20_ZNF512B_NM_020713_1.52743
GGTTGGAGCCTTCTGGCCCAAGGATGAAGCCAGAGACAGGAAGTGTTCTG
CAACCCCAGTCCCCAAAGTGCTCCTGGAACTTGTCTCCCTACTACTGCAG
GCCAAG 3026. chr20_C20orf201_BC036837_-1.91016
AGGCTGGGGCGCGTCGCACACTCTC 3027. chr20_MYT1_NM_004535_1.75205
TCCAGCAAGCAGAAAGGCATCCTGAGTCACGAAGAGGAGGACG 3028. chr21_CXADR_NM_001338_-1.52528
CTGTAAAAAATGCCTCTTCTGAGTA 3029. chr21_TMPRSS15_NM_002772_2.04411
AAAAGCCCCACTCGTTCTTGTCTCCCTCCTGGTCCAGTTGGGGTAGAAAT
GT 3030. chr21_ADAMTS5_NM_007038_-1.70689
CATTGCTTAAACGCAGAAGGCCTTTGGGAGAGAGGACATCCTTTTGCTAA
CTTCCGGTTTCCATCCTGGCACTGCACCGTTCTGGTGTGCCAAC 3031. chr21_C21orf7_NM_020152_1.66934
GGGGCTGGCAACAGCTTCGTAATCCTGGCTTCCTGCTTTCTGGGTCAAAG
CCCTGGTGGTGTGTTCTTGATATCGGTCCATCTAGTGGCGTTGTTTGATT
CCTCCCACCTTGCTGATCATTCGTAGTGTAGC 3032. chr21_C21orf7_NM_020152_-1.56427
CTTTCCAGAATTAGACCAGCAGCTAC 3033. chr21_KRTAP19-3_NM_181609_1.50703
CTCCATAGTATGATGGGCGGTAGCAGCCATA 3034. chr21_KRTAP6-1_NM_181602_-1.58962
ATAGCCACAGAACCCATAGCCAGGGGTGCCATAGTAGTT 3035. chr21_OLIG2_NM_005806_1.70868
AGGAGGACCCTGCGAAAGCTGCGACGACTATCTTCCCCTGGGG 3036. chr21_IL10RB_NM_000628_-1.85914
TGGTACCACCTCCCGAAAATGTCAGA 3037. chr21_SETD4_NM_017438_-1.5844
GTGGGCTATGATTCAGCAGGTCCAGGTACGGAGCGAGTGCACAGGTGTCC
GGCTCTGCAGAAAGGCATTCCCGCTGCCTGGGCCTCAGGTACACGGCTCT
GGTGTTGACGGTGCACCAAGCCCA 3038. chr21_CBR3_NM_001236_1.62271
AGGAAAGGTTCCACAGTGAGACACTCACAGAAGGAGACCTGGTGGATCTC
ATGAAAAAGTTTGTGGAGGACACAAAAAATGAGGTGCATGAGAGGGAAGG

Figure 3-245

CTGGCCCAACTCACCTTATGGGGTGTCCAAGTTGGGGGTCACGGTCTTAT
CGAGGATCCTGGCCAGGCGTCTGGATGAGAAGAGGAAAGCTGACAGGATT
CTGGTGAATGCGTGCTGCCCAGGACCAGTGAAGACAGACATGGATGGGAA
AGACAGCATCAGGACTGTGGAGGAGGGGGCTGAGACCCCTGTCTACTTGG
CCCTCTTGCCTCCAGATGCCACTGAGCCACAAGGCCAGTTGGTCCATG 3039. chr21_MORC3_NM_015358_-1.51471
CAGTTGGATTATATGGGAATGGCTTCAAGTCGGGTTCTATGCGTCTGG 3040. chr21_KCNJ6_NM_002240_1.63358
CTCATGGAAGCTGTTGTAGTCAACTTCGTAGAACCCGTCCTCCAGGGTCA
GGACAGGTGTGAACCGGTAACCCCACAGGATCTCACTGGTGATGTAGGAG
CTTCGAGC 3041. chr21_ERG_NM_004449_-1.73034
TGATATGAGCTGCTGGGTCCGGGACAGTCT 3042. chr21_C21orf129_NR_027272_2.12425
TTCCCAGGGATCCACAATCTTCTA 3043. chr21_PRDM15_NM_022115_-1.80098
TTGGAACCGAGCTGGTGTCAGTGGTGGTGGTGGCCAGCTTCCCCAGAACC
AGCTCCATGATCCGCTCATCTGGCGTTGCACTCACAGGCTCATCCGGAGG
GACCTCGGTAATGATCTCTGCCA 3044. chr21_ABCG1_NM_016818_-1.56682
CGGGAAGTTCAATAGTGGTGAGTTGGTGGCCATTATGGGTCCTTCCGGGG
CCGGGAAGTCCACGCTGATGAACATCCTGGC 3045. chr21_ABCG1_NM_016818_1.50559
CTCGCTGATGAAAGGGCTCGCTCAAGGGGGTCGCTCCATCATTTGCACCA
TCCACCAGCCCAGCGCCAAACTCTTCGAGCTGTTCGACCAG 3046. chr21_TFF3_NM_003226_-2.06491
CAGGCCCACGTACTCCTCAGCAGA 3047. chr21_TFF2_NM_005423_-1.61198
ACAGACTTCGGGAAGAAGCACCAGGGCACTTCAAAGATGAAGTTGGAGAA
GCAGCACTTCCGAGAGGCGCATTCCTCGGGGCTGATGCCCGGGTAGCCAC
AGTTTCTTCGGTCTGAGACCTCCATGACGCACTGA 3048. chr21_RRP1_NM_003683_-1.65067
AGAAAATAAAATGCCGCGCAGCCCTTG 3049. chr21_PWP2_NM_005049_-1.51772
CACCCAGTTCTCCTGTGTGGCGGTGGATGCGAGCGGTGAGATCGTCTCTG
CAGGGGCGCAGGACTCCTTTGAGATTTTCGTGT 3050. chr21_C21orf33_NM_004649_-1.56874
GGGCTGAAGTCCAGATCTTTGCTCCTGACGTCCCTCAGATGCACGTGATT
GACCACACCAAGGGGCAGCCGTCCGAAGGC 3051. chr21_ICOSLG_NM_015259_1.66018
AAGCCCCGCATGTTCAAGAAGACGGTGTCATTCTGCAGAGCCTGGTCCAG
CAGGCTGTTGTCCGTCTTATTGATCCAGTACACGTTGGGCCTGGGGTAGC

Figure 3-246

CGTTTATGGATGTACACGTGAAGGTGAGCTCATCCTGGGAGGGGCTGTGG
GGGGCGCTGACGACGGGCACGCTGAAGTTT 3052. chr21_DNMT3L_NM_013369_1.55931
GATGAGCAGCGTCTCTCCGGAGCAGCAGATGGAGCAGTAGGATTGGTACC
CGTCATCGTCGTACAGGAAGAGGGCATCCA 3053. chr21_AIRE_NM_000383_1.65147
CTGGGGAACCCCTAGCCGGCATGGACACGACTCTTGTCTACAAGCACCTG
CCGGCT 3054. chr21_PFKL_NR_024108_-1.5023
GGCAGCGGCCTACAACCTGGTCCAGCACGGCAT 3055. chr21_PFKL_NR_024108_-1.74183
CTGCTGGAAGCCACGCCTGACACGCCGGCCTGCGTGGTCACCCTCTCGGG
GAACCAGTCAGTGCGGCT 3056. chr21_C21orf2_NM_004928_1.75963
ATCTTTTATTAGGGAGGACAGCCTGCAAAATCCTCCCTTTAAGAGCCCAG
GCCAGCCTAGAACCTCCAGACCACAGAAGGGGAGTCCTGGGGACAGGACT
GGTGTAGACAGGCATCTCCACCGCCCCGGTTAGCCAGTACCTAACACCCA
CTCCTGCCCTCGGCCGATGTGGCAAA 3057. chr21_TRPM2_NM_003307_-1.71273
CGCGGCCGCCATGGACCCCATGGGAGA 3058. chr21_POFUT2_NM_015227_-1.59857
AAGCCGCCCCCGACAGAATATCGGCCGCCGATTGTCCGGGCCAGAACT 3059. chr21_SLC19A1_NM_194255_-1.88962
AGGCCAGCACGTCCGCGGTGACCGGGACCAGTCCCCTCCGGGCTGGCACA
AGTGTGGGAGCA 3060. chr21_SLC19A1_NM_194255_1.61846
GGTGATGAAGCTCTCCCCTGGCCGTATCTGCGCCATGAAGCCGTAGAAGC
AAAGGTAGCACACGAGGTGCCGCCA 3061. chr21_PCBP3_NM_020528_-1.79444
CACCGGCATGCAGTGGTAATTATTTTAGAAATATTGTTCCTTGGTGTCAG
CGTAGCTGTCTGTCTTAGGAGCTGGGTCGGCGTTCCGACAGCACTTCCTG
TCCGCCCTTCTCCTCTGCCATCCAGAACCGTCCAGAACTGTTGCCTGAGA
CCCCTCCTCTCTCACACAGCCCTGCCATGCTGACTCGGTTTCCCCTCAGA
GCCATTGTTGTCTGGGCTCGAGTTTCTGCCCCAGGTTGTGTGCTGGAATC
GGGGGGTGGCTCTCCTGCCACCCATGGGGAGCGCCAGGAGAGGAGGGTCA
TGGAGGATGTTGGGGCTCTGACCCCAGGAGTGGGGTGGAGGGCGGAGCCT
GCTGGGGGCCCTGCCTTCACAGAGATGCCGCGTGCT 3062. chr21_COL6A1_NM_001848_-1.72796
ACCCCAGGCACGCGGGGACCAAGAGGAGAC 3063. chr21_COL6A2_NM_001849_-2.29693
GGTATCAAGGCAACAGTGGAGCCCCAG 3064. chr21_PCNT_NM_006031_-1.53564

Figure 3-247

TGGACAGGCGGCAGGCCCGCAGAGCCACAGCTCACACACGGGTGCCCGGG
GCCCACCCACAGCCTCGCATGGATGGTGGCGCCAAGGCCCAGGTCACCGG
CGACGTGGAGGCCTCCCATGATGCTGCTTTGGAGCCGGTTGTCCCTGACC
CACA 3065. chr21_DIP2A_NM_015151_2.21109
CTCTGCCCGGACGCTAGCCGGCCTGG 3066. chr22_CECR1_CR456417_-1.56252
ATGCGCCCGTGTTTCATCTATGGATAGAGCTGAGCCGAAGAAAGACATTG
CCACAGCCAACAGCAAGAAGCACAGGGCTGGCCGCT 3067. chr22_BCL2L13_NM_015367_1.52874
CCGGCCGTGACGAAGGCACGCCGGGGTGACCTCACCCTCCAACATGGCGG
CGGCGGTAGATTAGGGCCGCGGGTCGGAGCACTCACCGCCGCTGGGGGAC
CCTGTCGGAAGCAACTGCCG 3068. chr22_PRODH_NM_016335_-2.2049
CAGCGGGACGAAGCGGGGAATGCA 3069. chr22_SEPT5_NM_002688_1.51817
AGAGCGCGCCCTTCGCCGTTATAGGCAGCAACACGGTGGT 3070. chr22_GNB1L_NM_053004_-1.5278
CGGCAAGCGTCCAGCGTGGCTGGCCCCCGGCCAGGATGCTGCTCCGGCAG
AAGCCCACACTCTCCAAGCACACGGAGTCCACGACAGCGCTCCTGCCCTC
CGCGAGGTCCCACAGGCAC 3071. chr22_GNB1L_NM_053004_1.79942
TGAGAAGAGGAGCGGGCGCCCCTGAGCCTGGGCTCCTTCGCAGAAGTGCA
GCGCATGCACCGGTGACTGGGTGCCTCGGAGGACAAACT 3072. chr22_ARVCF_NM_001670_1.9024
CAGCTGTTGCCAGGCCATTGGCAGGGGCTGCCCACTGCCCATGCCACCAC
TGA 3073. chr22_C22orf25_NM_152906_1.67726
TCCTGGAGGCTGTGGAACGGAGCCA 3074. chr22_DGCR8_NM_022720_-1.67628
CCTCTCCGCTCCCGTGTGGGCCCGCAG 3075. chr22_ZDHHC8_NM_013373_-1.96808
TCTGATGCCTTCTCGGGCGCTTTGCGCTCCCTGAGCCTCAAGGCCTCGAG
CCGGCGGGGCGGGGATCATGTGGCCCTGCAGCCCCTGCGCTCTGAGGGGG
GGCCCCCCACGCCCCACCGTAGCATTTTTGCCCCCCATGCACTGCCCAAC
CGCAACGGCAGCCTGTCCTATGACAGCCTGCTCAATCCTGGCTCGCCTGG
TGGCCACGCCTGCCCTGCCCACCCAGCAGTTGGCGTGGCCGGATACCACT
CACCCTACCTGCATCCTGGGGCAACGGGCGACCCGCCACGGCCCCTACCC
CGCAGCTTCAGCCCCGTGCTGGGCCCCCGCCCCCGGGAGCCCTCGCCTGT
GCGCTACGACAACCTGTCCAGGACCATCATGGCATCCATCCAGGAGCGCA
AGGACAGGGAGGAGCGTGAGCGCCTGCTGCGCTCCCAGGCCGACTCACTC
TTCGGCGACTCAGGCGTCTATGACGCTCCCAGCTCCTACAGCCTGCAGCA
GGCCAGTGTGCTGTCCGAGGGCCCCCGAGGTCCCGCGCTGCGCTATGGCT
CCAGAGACGACCTTGTGGCTGGGCCCGGCTTCGGTGGCGCCCGCAACCCT

Figure 3-248

GCCCTGCAGACGTCACTGTCCTCGCTGTCCAG 3076. chr22_THAP7_NM_030573_-2.1191
TGGGCAGCCCCTCGGTCAGTCCAGCAGCCCC 3077. chr22_PPM1F_NM_014634_0.0108929_-1.65471
TGGGAATCCCCGAGCCAGGCGACGTGCAGGGTCGCTCCTGCAATGAGCGC
ACACA 3078. chr22_ZNF280B_NM_080764_1.51776
TAAATTTAGCCCAGTCCAGGAACTGGACAGACACCACTTGTTTGGCCCTT
TTCAGTTAAAACTATGGGTCCAGTACAGTTCAAATTATAGATATTAGGGC
TTCTTCCCCTTGGGAAACTTGCTTTACAGCTGTGGCTGAGAATATGGCCA
GTTCATTCTCCACTAACGGCTAGCCAGAAGGGAGAGGAGAGGGAATGAAT
CAAATTCACCTTTAGATCACAGAACAGGAAGTCAGCTAGTACCAGGCACC
ATTCTATTAATTTTATTGCTATTTCACCTCAAACCAATGATACATGACGG
CTGTTTGATGTCTGCAGGGGCCCTTCACCAAACAAAACCATTTTACTTTG
AATGGTTTGGCTTCCTTGGATGTTTTCAGGTAGGTAAAGATACTCTGAAG
CAGTGTTCCTTTTGACCTGGCCCCAAGACTAGAATGAA 3079. chr22_ZNF280B_NM_080764_-1.62397
GCACTTCTGGGAATTCGGCAGCAAGTGGGCCAGGGCATAACAAAGCCATT
CCAGTCTGACTAGAGTTAACCATGAAATGCTGAATGCATGGAAAAAGCTG
TAAAGAAAACTAAGTATTTCAAAAATTCTATGAATTCTGTATATAGAAAA
AAGAGCTTTCAAGCTTAGGAGTAACATGAAATACCAAAACAATAAATAGG
TGCCAGGG 3080. chr22_IGLV2-23_ENST00000390306_-1.51815
ATGTTGGGAGTTATAACCTTGTCTCC 3081. chr22_GNAZ_NM_002073_1.57979
GATGTCGGCAAAGCTCAGAGGAAAAAGAAGCAGCCCGGCGGTCCCGGAGA
ATTGACCGCCACCTGCGCTCAGAGAGCCAGCGGCAACGCCGCGAAATCAA
GCTGCTCCTGCTGGGCACCAGCAACTCAGGCAAGAGCACCATCGTCAAAC
AGATGAAGATCATCCACAGCGGCGGCTTCA 3082. chr22_FBXW4P1_NR_033408_-2.0292
CGCGGCTCGGCACCAACCTGATGACC 3083. chr22_VPREB3_NM_013378_1.69361
ACTAAAGCCGTAGCCAACAGAGCAGTAGTAATCCGCGTCGTCTTCAGGCT
GCACGGGACTAATGGTGAGGACACAGGCATTGTGGGCCTCATCCTTGGCT
GCCGAGAATCGATCGGGGATGTCAGCAGGCCGGTGGTGATCCTCCTCCGA
GCGGTAGTAGA 3084. chr22_SLC2A11_NM_030807_-1.58596
AGCGCCCCTAAGGAGCTCCGAGGAGCTGTGGCCATGAGCTCAGCCATCTT
TACGGCTCTGGGGATCGTGATGGGACAGGTGGTCGGAC 3085. chr22_GSTT1_NM_000853_-1.63824
TTTAATCAGATCCACGATGCGCAGCTCGAAGGGAATGTCGTTCTTCTTGG
CAAAGATGTAAACAGCGCGGCAGGGC 3086. chr22_CABIN1_NM_012295_-1.61133
TCCCCGTGGACGAGATTGACCGGCCGGGCAGCTTTGCCTGGCACATGAAC

Figure 3-249

CGCTCCATCGTGCTGCTGCTCAAGGTGCTGGCCCAGCTGCGGGACCACAG
CACCCTGCTGAAGGTGTCCTCCATGCTTCAGCGGACCCCAGACCAGG 3087. chr22_CABIN1_NM_012295_-1.8232
GAGAGAACTTCTTTCCTGTGACAGTGGTGCCCACAGCCCCTGACCCTGTG
CCAGCTGACTCTGTCCAGCGGCCCAGTGATGCTCACACCAAGCCTCGCCC
TGCACTAGCTGCCGCCACAACTATTATCACCTGCCCTCCGTCA 3088. chr22_C22orf36_ENST00000446942_-1.61101
CGAGGGAGCCGTGCTCCACTGACGCCAATCCCAGGGAGTAGGAACAAGCC
AGGTCAGCGTGTTCTTCTTCCTCTCACTCTCCAAGCGAGACTGCGCCTGC
GGG 3089. chr22_CRYBB3_NM_004076_-2.09985
TGGCGGAACAGCACGGAGCACCCGAACAGGCTGCAGCTG 3090. chr22_LRP5L_NM_182492_-1.58127
AGCGTGGCCTGACAGCGTACGGCCGGCACAAGAGAGGCTCGAC 3091. chr22_MYO18B_NM_032608_1.50685
TGCAGTCCTGGTTGAGCTGTACTCTGTCCCTGGCCACAGATACTATGAGG
ACTCCTTCTCGACA 3092. chr22_SEZ6L_NM_021115_1.54245
TTTACCCGAGATCCAGAATGGCTGGAAAACCACTTCTCACACGGAGTTGG
TGCGGGGAGCCAGAATCACCTACCAGTGTGACCCCGGCTATGACATCGTG
GGGAGTGACACCCTCACCTGCCAGTG 3093. chr22_HPS4_NM_022081_-1.51515
ACTCTGGGCTAGTGGACGATCAGGTTCTAGAAAAAATGCCAACTTGGAAG
CTTGTGGCACCAATTCAAGCTGGGATGGAACAGCAGGAGATATGAAATAC
CTCAGGCTCAGTATGGCAGAGAGGGAGCCAAGCCCGTCCCGGCCCCAACA
CTACCGATTAAATACAGTTCTTTATCAAGTGCTCTGGGTCTGCCGACCTG
AAGAACTAAC 3094. chr22_HPS4_NM_022081_1.57661
AGGACTCTGCTGGTGTCAGCCTGG 3095. chr22_TFIP11_NM_001008697_-1.64223
TGCTCATAGGGCTCAAACTCAGGAGTGCTAGAAGTCAGGCCTCGGGCTTG
TCTCTCTCT 3096. chr22_MN1_NM_002430_-1.62117
GCCGGGCACCGACAGAGCGGTCCCTCCCCCCGCCCCCCGGAGTCCCCGCG
CCCCGCAGCCCGAGCCTCCACCGAGCACGATCCGCTCG 3097. chr22_RASL10A_NM_006477_1.68775
CAAGTCGTAGACGGCGCCGTCGAGCAGCACCGCGGGTCGGTAGAGGCGCG
GCCCGTCCGTGGGCCGGTGGCGCTCGGGGTAGTCACCGAACAGGAACTGG
CGGATGATGGCCGTCTTGCC 3098. chr22_ASCC2_NM_032204_-1.52926
CATGCGGAGGAAGGTGAGAAAAACACTTCGATGGAGGCGCTTCTGCATGT
CAACAACCTCAGGGGCTGAGGCCACCCCCTCGTCGAATTTGCGGGGGACA
TAGCGCAGGTAGGAGTCCAGGCACTTCTGTAGAGTCTCGTCAAAGATCAC

Figure 3-250

3099. chr22_GAL3ST1_NM_004861_-1.66466
AGCCTGAGTTCCAGTGAGCCATGACT 3100. chr22_FLJ20464_CR456348_-1.63528
AAATTCCCAGAAGTCGCCTGCGACCGCCTCCCTGCTTCAAACACCAGAGA
GGGCCCGGGGTCCTGGCCGGAGACAGGCCGAACCTCCGGAGCTGCTTCTG
CACCCGGTACATT 3101. chr22_SFI1_ENST00000433295_-1.61301
GTGCTCCTCACTGTTTGACTGACCTTGATGGGATCCTGAACGTCTCAGAG
GCTGCTCCCCTGTGACATGGACCCTGGCGACCTGTACACCAGCGTCACCA
GGGTTGTTCTGCAGGTCAAAAGAGACAATGTGGGTGAAGCAGTCCCCTGG
CGTCAGGTACCTTTTGTCG 3102. chr22_DEPDC5_NM_014662_-1.75851
GCTCCGCCCAGTCAGCCGAGAGCAGCAGCGTTGCCATGACTCCC 3103. chr22_C22orf24_AK294232_-1.5053
CAATGGAATGTACCCAGGAGCCCCTAATCCCCCATTGATTTAGTGTTCGG
GCTTGGTCAGCAGTCTTCTTGTCCCACTGCAGGCATGTGCAGCCCCGGCT
CTTTCTGAGTTAAGCCAGGGACTGAAATGGGTCGGCAGAATGCTCATCTG
TTGGGCGCTTTATGGTTTATAAAGCCCTTTCCCTTCTGTGCCCTCCTCAC
AACCCCATGGAGACTCTGCACGGCCCCTCCAGCTCTTAGAGGCTGCATTT
TGCGCAGTGAAGGCCACATTAAATATTAACAGGGCAGCTCCTGGCCCCGC
TGTGACGTCAATTACGGGGCCGCTTGGTGAGGGCTGCGGATGCCTTTCCA
AGGTGAAGCGGTGACCG 3104. chr22_---_---_-2.06888
TGCAAGCTCCACTTTCCAGGTTCACACCAT 3105. chr22_RBM9_NM_001031695_-1.63709
GAGGTACCGCTCGGACTGCACCATATACTGTCCGCCCTCTGCCCCTCAAA
TGGGCTCCTCTGAAAGCGGCTGCCGTGGTGGCTGCAGTAG 3106. chr22_EIF3D_NM_003753_1.98995
GAAGGTGCCATCAGGGAGGCTGTAGACACGGATGAC 3107. chr22_---_---_1.54494
GACGGAGGAAGTCAGAGATCTGAAGCACAAGAAGGATCTGATGTGCTGTT
GCTATCTTGGAGATGGAGGGGGCCATGTGACAAGGAATGCAGGTGGC 3108. chr22_---_---_2.23328
TTGCTTTCTGCCACCATTGCAAGTTT 3109. chr22_---_---_-2.11021
CGATCTCCTGATGTCAAGTGATTCTCCGCCTCGG 3110. chr22_CSF2RB_NM_000395_1.56755
GTGCTTCTTTGACGGGGCCGCCGTGCTCAGCTGCT 3111. chr22_CSF2RB_NM_000395_1.59974
AGGGGCTCGGCAGCCTCCACACCAGGCACCACTGCCAGATTCCCGTGCCC
GACCCCGCGACCCACGGCCAATACATCGTCTCTGTTCAGCCAAGGAGGGC
AGAGAAACACATAAAGAGCTCAGTGA

Figure 3-251

3112. chr22_C1QTNF6_NM_031910_-1.815
ACGGGAAGGAGATACCTGCCCCTGCCACCGGGACCCCGTCCCACCAGCCT
TGGGGAGCAGTGGGTAATGGAGGACCAGCAGCACCTGAACACCCAGAACA
CAGGCCCCCATGAGCTCTGGGTCTGCTTTAAAACCTATGTACACATCTCT
CCCCGCCTGGGCTGGACTGGCCAGTCACTGAGGGCAGGGGCAGGGCCTGT
GTCTGACCCCCTCACCCTTCCCGGGACCCAGCACAGAGTGAGTGCTCAGT
GTTTAATGAATGAATAAATGAACGGTGGCTGCAGTGGTGCAGGCCTGAGC
AAGAGAAGAGGGGGAAGGGGTAAAGAGAACATAGCACGGGGAGCCCTGGA
GGGATGAGAGAATTTAAGAATGTTGGAATTGGCCAGGCACGGTGGCTCAC
ACCTGTAATCCCAGCATTTTGAGAGGCCGAGGCGGGTGGGTCACCTGAAG
TCAGGAGTTCAAGACCAGCCTGGCCAATATGGTGAAACCCCATCTCTACT
AAAAATACAAAAATTAGCCAGGCATGGTAGCAGGCGCCTGTAATCCCAGC
CACTAGGGAGGCTGAGGCAGAAGAATCGCTTGAACCCGGGAGGCAGAGGT
TGCAGTGAACTGAGATTGCACCACTGCACTCTAGCCTGGGCAACAGAGCA
AGACTCTGTCTCAAGAAAAAAAAAATGTTGGGAGAATTCTAGAATGTGGGG
AGGATTCCAGAATGTTCAGAAAGTACTAGAATATTGAGAAAGTCCTAGAA
CCTGGTTGCTCCAGTGTGGTTCATAGACTGACCCCATCAGCATCACCCAG
GAACATATGAGAAACACAGAATCCTGGACCCACTCAGACCTGCTGAGTCA
GAATCTGCATTTAACACGAACCCCGGGTGATTCGCATGCATTTCCAAGTT
TGAGAAGTGCTGGGCTACGAGGCTGGGAAAGTTCTAGAATATTTAGGTTA
GCAAGCTTCTTAAAATAGGTCCAAGAGAGAAGAGAGGAGCAGAAATAGGC
TGGGAGGGATGATGGCAGCCAAGATAGAAGCAGGGTCTCCCCAGAATGC 3113. chr22_CARD10_NM_014550_-1.7749
TCTTCCTCACGCTGCCGGCGGAGGATGGAGCCGGCACTGGGGGGGAAGGG
CAGGATGGAGAGCCGATTGATCTCCTTT 3114. chr22_GGA1_NM_013365_-1.76003
GTGTATGACCAGCACGGCTTCCGCATCCTCTTCCATTTTGCCCGGGACCC
ACTGCCAGGGCGCTCCGACGTGCTGGTGGTGGTGGTTTCCATGCTGAGCA
CCGCCCCCCAGCCCATCCGCAACATCGTGTTCCAGTCAGCTGTCC 3115. chr22_TRIOBP_NM_138632_1.6692
TCACTGTGCCCGTTTTACAGACAAGGCCACTGAGCTCTGAGAGGTTATGT
GACTTGCCCAAGGTCACCCCGCCTGCAGGTCTCAAAGGTGGGATTTGA 3116. chr22_TRIOBP_NM_138632_1.57501
GAGAATGCACCGTCCGCCTAGGACAGCGGTTCTCAACGGGGTCCATTTTG
TCCCCCTTGGGGACATTTGGCTGTGTCTGGGAATACTTCTGGTTGTCACA
ACTAGGACAAACTAACTCTCTAGAAAAAACGTGTGTGTG 3117. chr22_GALR3_NM_003614_1.85609
CACTGCCTGGCCTACGCCAACTCCTGCCTCAACCCGCTCGTCTACGCGCT
CGCCTCGCGCCACTTCCGCGCGCGCTTC 3118. chr22_PICK1_NM_012407_1.55489
GCAGCCTTGGACGGCACAGTGGCAGCTGGCGATGAGATCACCGGTGTCAA
TGGCAGGTCAATCAAAGGGAAAACTAAGGTGGAGGTGGCGAAGATGATTC
AGGA 3119. chr22_CSNK1E_NM_152221_1.71868
GAAGCCACGGGCTCGGCGGCACTGCGGAGCCGGTTGGCAGTGGCCCCCGT
GGGTGGGCCAGGGGGCAGGGCTCGGGTCGCGGACCCCCGTAGCTGCCCCA
TCCTCTCCTCGCGTTCGTGTT

Figure 3-252

3120. chr22_SUN2_NM_015374_-1.5018
AGTGCTGTTGGGTGACAAGGCCTTGGGCACATGCTCTAAGGTAACGGCTG
TGGGGCGGATGCGGGCAGAGAGGCGGACCACGGCGAAGCCTTGTGGCCC 3121. chr22_CACNA1I_NM_021096_1.53169
TGAGCCGGCATGCCACCTTCGAGAACTTCGGCATGGCCTTCCTCACACTC
TTCCAGGTCTCCACGGGTGACAACTGGAA 3122. chr22_TNRC6B_NM_001162501_1.50322
TTAAGCCAACCAACGGCCGCCAGCCCAATTGGCAGCTCTCCATCGCCACC
AGTCAATGGTGGCAACAATGCCAAAAGGGTGGCAGTGCCGAACGGACAAC
CGCCAAGC 3123. chr22_TNRC6B_NM_001162501_-1.86355
ACTCGCCCTCTCATCCTGTTGGGCC 3124. chr22_ADSL_NM_000026_-1.58304
TTTGCACCGACATACGCCTCCTGGCAAACCTCAA 3125. chr22_SGSM3_NM_015705_-1.57194
CGGGAGGTCGAGAGAGACTTTGCCTCCGTGTATTCCCGTCTGGTGCTCTG
TAAGACCTTCAG 3126. chr22_XPNPEP3_NM_022098_-1.7258
TTTCCTGGCGACGCGGCCCTGCAGGCGGTTGCGTTCCCCGTCGTTACCCT
CTTTCTCTTCCCGACGCGTGAGTTAGGCCGTA 3127. chr22_C22orf46_NM_001142964_1.71596
CAGACTCGCCCTGCCTTGGACATGTGTCAAGAGATGGAGCAGCTGCTGCT
TCACTCACAGGAAAGGTTGGTGTCACTGGAGCCTGTCATCAGTGTGAGGT
CTCGCCCCACCTCCATGACCTTAACCACCTCTCTTCCAAACTTACTTTCA
GCTGAGAGGCTGCAGTTCTGCCCCCAGAGAGCTCCTGCCTGATCCTTCCC
ACCAAACACTGAGAATGTGCACTTGGAAGTC 3128. chr22_SEPT3_NM_145733_1.74979
AGGAGAGCATGCCTTTTGCTGTGGTGGGAAGTGACAAGGAGTACCAAGTG
AATGGCAAGAGGGTCCTCGGCCGAAAAACTCCATGGGGGATCATC 3129. chr22_WBP2NL_NM_152613_1.62022
TGGCGGTGAATCAGAGCCACACCGAGAACCGCCGCGGAGCCCTCATCCCT
A 3130. chr22_NFAM1_NM_145912_1.51962
AAACAGGCCCGGAGTTCATTCAAATCCAGCCTCTGGGAGCAGGGGCCTTG
CCACTCGGTTATGTGAGCCTGCTAAAGCCCTCCTTGCCATGTGTGCTTGC
AGGCGGGGGCCCAGAACCAAGTTGGGAGGCCACTGGCTGTCCTGTGGGAC
CAGAGAAGTCTGGTGCCACCCTAGCAGGGCCAAGGGACTTCTTCTGGACG
TCAGTCTGTGCCCAGCCTCTACCACCAGCTTTCCCTTCCCTGCAGGGAGG
GGCATGACCTGCAGAACCAAAGGTGCTTCTGTGAGCCAGTAGCCCAGTGC
TGCTTGGGGGCAGGGGCGGGGCCTGTGCCTTGGGTTCCCCCCCCTCCCTG
GGCACATTTGGGGTTGGGGCAGCCCACACGGTGGGGTGGGAAGATTGACC
TGCCCATTTTACAAATGAGCAAAGGTGGGAGAACTCAGGGAGACATGGGG
GAGCAGAGGGAGGAAGCAGAGCCCAACAGCCCGGGGCACCCGGACCCCAG
CCACTGCCTGCCTGTGGATGGGTTTCTGGCCACGGTGCAGGGCTACTGCG

Figure 3-253

AGGAGGAAATGAGGGTGATGTGGGCACCTGAAACAGCAGAAATGGCTCAG
GGCCAGGCACTGGGGAGCCACTGTCCCCATGGGGCTTGAGCTTCTGCCTC
AGAGGGACCTTCCGGCTGCCATTGAGGGTCCCAGCACCAAACCCCACAGC
TGGACCACTTGGGACCTCAATCCACAGGGGGCCAGGGCTGCGGCCTATGG
CAGATAAAGATAGAGGAGGAGGGCTGGATGAAGCCACAGGTGGTGGGCAC
AGGATAGGCCAGACAGAAGGGACTTTGGGGGACTCCACCTTGGGTAGAAG
GAGGGACAGCTGAGGTCCTGTGGTGGAGAAGGCCTGGAGCAGAGGGTGAC
CAAGGAGATGACAGAGTGCACGTACAGGGCCAGGCCAATGGGAGTGGGAA
CCCTTGGGAGAGGGAGCTTCAGGCCATTCATTCAGTTCCTGTTTAGCCAG
CACCCTCCTCCCCTCATCTGTCCCTCTGCCCTCACCCCAACATGCCAGAA
TCTCCTTCCTCTCCAGCTTGTACCCAAGCCCTCTCTGCTCCATGCCCCCA
GCCTGCTGACCACCTCTCAGCCATGTCCTGGGCCTCCAGATCTGTCCCTG
ATCCTAGTCTTGCCTCTGAGGGGTCCATCATCCTTGTCTGTCCCCCAGAC
CTCCCACGCCAGCCCCTGCTCCCACCCTGCCTGGCTGCCTCGTGCCTCTG
GCCCAGCTGGGTAGGTAGGGATTTGCATAGCTGCTCCCCAGCTCCTCCAT
ACCTCGGCTCCCCACACAGCACTGCTAGGCGCCCCTGCAGGGTCCTCCCT
CAGCTCAGAGGCTGCCCTACTGGCTGAGGTGCAGGCTGGTGCCAAGAGAG
CATGCTGCTCTGTCAGCATGAGGCAGTGAGCAGGGCTCTGGGCAAGGGTG
GCATCCAGGAAAGCCCTTGAAGACTGAGGGGCGCTTTGCTGGTTGGGCCA
AGGGAGGAAGGGCCTGCCTGGCAGAAGGAACAGCCTGGGCAAAGGCCCCA
AGATGGGAAAGCCTTGGTGGTTGGGGCATAGAATGGGGGGGCAGTGGGGC
CGGCCAAGACAGGAAGGGCCTTGAATGTGAGGGTCAAATGATGCCGTCTC
CCTGGGGGCCTTACTCCCAACTCAGATCAAGTCCTTTGGTGGCAGGGGCT
GCCCCGGTCCTCTGACCCAGGGCAAGCTCTATGAGCGGTGGAGCCCA 3131. chr22_PACSIN2_NM_007229_-1.53684
ATGCCCGGCCCGTGATTGGCTCGGAACCACCTCAGGTCCTCCACTGCATC
AGCTGCTCTGATGCTC 3132. chr22_SCUBE1_NM_173050_1.80422
CCTGGTGGTTCTCCGAGGCGTACAGGCGCCCATCGCGCACGATGTCCTCT
ATGAGTTGCTGGTAG 3133. chr22_SCUBE1_NM_173050_-2.42049
AGCAGCGGCTGCCTGGCGGTCTCCTTTGCTCGTGCCTGG 3134. chr22_LDOC1L_NM_032287_-1.64354
TAAAGATTCCGTGCTCGGGCAGGCAGGGCTGGCGCTGGACTAGTCCCGTT
GGAAGCTGGATGCAC 3135. chr22_SMC1B_NM_148674_1.55407
CCTTAAGTTCTTTATAACGATCCAG 3136. chr22_PPARA_NM_005036_-1.96443
CAGTGTCATGTGAGGACGTGCTTC 3137. chr22_PPARA_NM_001001928_-2.25239
CTGGCAAGTTCGATGTTAGCTCCCGGGACACTCAGCAGCGATGGTGAGCA
TTTTGGTTTCCTTAAGGCCCAGCAAGACTTCCAGGGACATCTCTGGTGAA
GCCAGAATGGAGACACCCGTGACCTCAGGCTGAAAGTCACTCGACATTGG
TCTCTTGTGTTGATAGGGAAGGAAATCAGGCATTCCTATTTCTTTAAATA
ACAAAACCACTAATTGCCACTCAATGCTGGAATATTTTGGGTCACCTAAT
CATAGATTTCTCAGGGCATCAATACTCAAATATAGGCTGATTATGCCCCA
GTTCAAATGGGAACTATTAACAGAGTGCATTTCTTGCTTGCTGGGTTTCA
ACAGACATCAGCCAAAAGAACAAAAGAGATGTCAGGACAGATTCCAGGAG

Figure 3-254

TGTCGGAGCACATGTGTGGCACCCGCTCCCTCTGGCAGCGAATGTAGGAA
GTCGCCAAATTTACCCACTCTTCAACAAGTCATTGTTTAAACACGGTTTT
TCATTTTCTCAACTTTTAATAGCAAAAAGTGCCAAAGTCCTCAGAGACCT
AACAGCCTTGGTCTACCGTGCTGACCAGGGTGAAGGCACGGCGAGGGACT
CCTCCCAGACGTGCCTCTTGTGTGCCAGCTGGCTGTGGCTCGGGAGCAGA
CGCAGGCCTCTCCATTGTCCAGGGGAGCCTGGCGGCGCATCCCTCCTCTC
CCACCTCCTGGCACTTCCAGCTGGGTGTCCCACATGTTGGATTCCGTCCC
CACCACACTTCCAGAGACCGGAGAACTGTGCAGGGCCTAAGGCCGTTTGG
ATGAATTGTCAAAACAAGATGCTTCCAGTTACAGCGGCAGGAGCGGGACT
GGGAGCACGGGCTGACGGCTGCTGGTGCCTTTCTTCCCACCTCGCTTGCC
TGTTTCCGCTTGACCCTTCCTCCAGCTCCGATGAGAAGAGTATAAAGCAT
CTTCCTAACGGGTGTGTTTGCTATACGAACATAATGGACGTGAAGTGGGG
CAGAAACCCAGAACTCAGCATTCAAGGATGCCCAGGAGAGCTGTCCCTGT
TTTAAAGAGCTGTGTTTTGTTTTGTTTCGCATTTAGAGAGCAGACAAGGC
ACCCTTCTGCTGCGCTGATACGTTTCTTA 3138. chr22_CELSR1_NM_014246_1.63828
GCACTGGCCGTTGGTCTTATTACAGTCGGGATCAAAGCCTTTGCTGACGG
CACAGTGGCA 3139. chr22_BRD1_NM_014577_1.55933
CGAGGCGGCGGCATCAGTGGAGATCCACATGCTGCTCT 3140. chr22_ALG12_NM_024105_-2.37648
GCGGCTGCCACGTCAATGTGCAGA 3141. chr22_MOV10L1_NM_018995_-1.682
TTTAATGTTGCAATCACCAGACCCAAAGCTTTGCTGATAGTGCTGGGAAA
CCCCCAT 3142. chr22_TRABD_NM_025204_-1.88137
GTGCATCCTAGCCCGCCCGAGGCCCCTGCCACCCCCCATGGGGGTCTGGG
CCCGGCCTCGCCTGCCCTCCTGGGCCAGTCACCCCTCCCCCAGCCCACCC
AAATAAAGGATTATT 3143. chr22_SELO_NM_031454_1.68749
GCGCTCGGGGCTTCGCTCGCGGCTGCCCGACTCTTGCCCCTCGGTCGCTG
TTCCCCGTCGCCGGCGCCCCGCTCTACGTTGTCGGGCGCCGCCAT 3144. chr22_SELO_NM_031454_1.66373
CGGGGCCTGCTTCACCCGCGTGCAG 3145. chr22_SBF1_NM_002972_-1.53843
ACTCTGGTTCTAGAAACTCGCCTGCAGCCGCTGGCTGGACCAGCACACGC
TGACGGGGCCGGACTATTTACAGGCCCATTGCGGGCTGTACCTTGGCCAC
CTCCCGGCACGGTGCTCAGCTGTGACGCCAAAATAAGTTAGGG 3146. chr22_LMF2_NM_033200_-1.53863
TGCAGCAGGCGCAAGACCAGGCTTGTGAACCACGGGCTGTGC 3147. chr22_KLHDC7B_NM_138433_-1.59663
CTACCTGCGCACCTGCATGTGTTCAACCCCCGGGAGAACACCTGGCGGCC
CCTGACCCAGGTGCCCGAGGAGGCCCCGCTTCGGGGCTGCGGTCTCTGCA
CCATGCACAACTACCTGTTTCTGGCGGGGGGCATCCGTGGCTCCGGTGCC
AAGGCCGTCTGCTCCAACGAGGTCTTCTGCTACAACCCTCTGACCAACAT

Figure 3-255

CTGGAGCCAGGTTCGGCCCATGCAGCAGGCCCGAGCCCAGCTCAAGCTGG
TGGCCCTGGACGGGCTGCTCTATGCCATCGGTGGCGAATGCCTGTACAGC
ATGGAGTGCTACGACCCGCGAACAGACGCCTGGACCCCACGCGCGCCACT
CCCCGCAGGCACCTTCCCTGTGGCCCACGAGGCTGTGGCCTGCCGTGGGG
ACATCTACGTCACCGGGGGTCACCTCTTCTACCGCCTGCTCAGGTACAGC
CCCGTGAAGGATGCTTGGGACGAGTGCCCATACAGTGCCAGCCACCGGCG
TTCCAGCGACATCGTGGCACTGGGGGGCTTCCTGTACCGCTTCGACCTGC
TGCGGGGCGTGGGCGCCGCCGTGATGCGCTACAACACAGTG 3148. chr22_CHKB-CPT1B_NR_027928_1.57625
TTGGAGACCAAGTAAAGGCAGAAGAGGTGCCTGTCGATCCCTGCCCCGGT
CATGGCCAGGCGGTACATATTCTGGTGCTTCTTAGCAGCCTTCTGGAAGA
GATCTCGCAGGTCTGC 3149. chr22_ARSA_NM_000487_-1.62594
TCAGAGAGCTGGAGGCGTGGCAGGCAGGGTCTGCAGTGGTATCACTGTGG
GCA 3150. chr22_ARSA_NM_000487_-2.28437
TGACGGCCGCCTCCTGAAGCTCCA

Figure 4-1

3151. chr1_ENSG00000201898_snoRNA_1.17744
TTTAGAATGTCAAAATTGATTTTGTAATAGTCAGGACAGGATAAACAGTCGCTATATTAAGACCATGTACGTGTC
CCTAGACCTAGTTCTTTCCCTACGTCTGTTTTTATAAATGCTGGTGATAAAC 3152. chr1_hsa-mir-181b-1 // hsa-mir-181b-2_miRNA_1.16141
AACAUUCAUUGCUGUCGGUGGGU 3153. chr1_U44_CDBox_1.14249
CCTGGATGATGATAAGCAAATGCTGACTGAACATGAAGGTCTTAATTAGCTCTAACTGACTAA 3154. chr1_ACA16_HAcaBox_1.10574
TTGGCCCTTATCGAAGCTGCAGCTGCTTCCGCATAGCTGCTGTGGTCAAAAAGGAGCCCAGAGTGACAGTTTTCC
TTGACGGTCGCCGTTCTGTTTGTTGTAACTGATCTGCAACATTTTGGGAAAATACAGTT 3155. chr1_hsa-mir-186_miRNA_-1.26223
GCCCAAAGGUGAAUUUUUUGGG 3156. chr1_ACA26_scaRna_-1.20014
ACTGGAGGACTAAGAAGGCTGAGTCTGATGAAGTAAGACTTTGCTGATACATTCCTCCTAGAAAAAAGGGTTGG
AGAGAGCAGCCTTCACTGAAGAGTATCACAGGGCTGACTGTACTACCCAACACTC 3157. chr1_ENSG00000201791_snoRNA_-1.14915
ATGCAGGTACTGTTATAACTGAAGTGTTTTACGGTTTTTTCTTCCTGCTTAAAGCACTTGGTACATAAGTATCTCTA
ACTCGATTCCATAATAAGACAGAGACGCTTGGTCTCAAACAT 3158. chr2_hsa-mir-933_miRNA_1.39658
UGUGCGCAGGGAGACCUCUCCC 3159. chr2_ENSG00000212581_snoRNA1_1.12901
TTATCAGCTGGGATAATCTTTACCTGTTCCTTCTTTTGGAGGGCAAATTAGGACATGATTGGGGTTCACATAGTAT
GCGATTAACGTCTCTGAGTAATCAGGACTTCCAGTACCCTGATTGTGCCTATCTGAT 3160. chr2_hsa-mir-216b_miRNA_-1.29243
AAAUCUCUGCAGGCAAAUGUGA 3161. chr2_hsa-mir-26b_miRNA_-1.27088
UUCAAGUAAUUCAGGAUAGGU 3162. chr3_ACA4_HAcaBox_1.12488
TACCAAAAGTTAGCTTTTTGGGGGGCAGGTTTTTAAGTAACCTTTGCCAACTTGGGCTATTTGGAAGAGTAAAAG
ACCACACTCCACAGTGGGCTATACCACTTAGTATAGTTCGCTACTATTTTGTGGCCTACATG 3163. chr3_hsa-mir-569_miRNA_-1.34492
AGUUAAUGAAUCCUGGAAAGU 3164. chr3_hsa-mir-944_miRNA_-1.25927
AAAUUAUUGUACAUCGGAUGAG 3165. chr3_hsa-mir-548i-1 // hsa-mir-548i-2 // hsa-mir-548i-3 // hsa-mir-548i-4_miRNA_-1.20759
AAAAGUAAUUGCGGAUUUUGCC

Figure 4-2

3166. chr3_hsa-mir-568_miRNA_-1.18586
AUGUAUAAAUGUAUACACAC 3167. chr3_hsa-mir-567_miRNA_-1.16603
AGUAUGUUCUUCCAGGACAGAAC 3168. chr4_ACA11_HAcaBox_-1.14069
GCGCTCACTAAGGCTCGGTCCTCTCCACGTGGTCCTGACCTGTCCTCTGTGAGCAAGAGAAACAGGACTGGTTTG
GGGGTGTCCTGTCTCAGTGGACACAGGACACCACGGTTTTCAGTACAACA 3169. chr4_ENSG00000202440_snoRNA_-1.14053
TAGCATATGATGGAAAAATCTTAATCTTCTGAGACTTGTGATGTCTTCAAAGGAACCACTTCAATGCAA 3170. chr5_ENSG00000212363_snoRNA_1.14444
GTGACATGTATGTTTTTGTTTAACTTGTATACAAAGGCTTATGGATAGGTGCAAAAATAAATTCTCTTTTGCAACC
CAGAACTCATTGTTCAGTGTGAGTTTTGATACATATAAGAAGGGATATT 3171. chr5_ENSG00000201551_snoRNA_1.13479
ATACCTAAACCCAAGAATCACTTTCTTATAGTGATGATTTAAACAGATGCAAACAGCGAGCACATCTTGTCACCTT
TGCGGGACTGTGGCTGTGCCCCTCGCAGTAAATTTGGAGGTTCTACATCC 3172. chr5_U95_CDBox_1.12758
GCGGTGATGACCCCAACATGCCATCTGAGTGTCGGTGCTGAAATCCAGAGGCTGTTTCTGAGC 3173. chr5_hsa-mir-581_miRNA_-1.26672
UCUUGUGUUCUCUAGAUCAGU 3174. chr5_hsa-mir-548p_miRNA_-1.17659
UAGCAAAAACUGCAGUUACUUU 3175. chr5_U19-2_HAcaBox_-1.13734
TTTCCAGCAGTAGTCAGCCATCCGGACAGAACCGTTCCTGTGATGGTGTTACACTGCTGGGAGAGGAATGTCTT
GTCTTCATCCGGTTGCCTGCGCCACTGTTCTGGTGGCGTCTGGCACTGGTGCAAGACAGAGCTGTGCTTCCCCGA
GAGTGTGCTAAGCATTCACTTTGGCTGCTTAGTTCTAGTCTGGGAGCAGACAGAG 3176. chr6_ACA33_HAcaBox_1.1639
AAGCCAGCCAATGAATCTGCTTACCTGATTGTGTTTGTGCAGACATACTTTAAAAACTGGCAATAGTAAAGCCAT
GTTACGAGCCTTAAGGACATTGAAGTCGTTAAGGTCCCTGAGAATGGCTATAACAAAT 3177. chr6_hsa-mir-877_miRNA_-1.31816
UCCUCUUCUCCCUCCUCCCAG 3178. chr7_hsa-mir-335_miRNA_1.32246
UCAAGAGCAAUAACGAAAAAUGU 3179. chr7_hsa-mir-591_miRNA_1.13852
AGACCAUGGGUUCUCAUUGU 3180. chr7_hsa-mir-550-1 // hsa-mir-550-2_miRNA_-1.29982
AGUGCCUGAGGGAGUAAGAGCCC

Figure 4-3

3181. chr7_hsa-mir-93_miRNA_-1.19393
CAAAGUGCUGUUCGUGCAGGUAG 3182. chr7_ENSG00000207217_snoRNA_-1.14222
TGGGTTTGGATTATGACAGGCCCATCCCCCTGGACCTCTCATAGTGCCCCATGCCAGAGCAAACTGTGGCCCCGA
ACCATTGCCTGGCTTCTGTACCCGTGGGCCACTGGCACTGAAGAGGGTTACACAGTG 3183. chr8_ENSG00000212342_snoRNA_1.13696
TCTCGTGGTAGTTTTCTTTTTGGCACATTTGTTAAGTTTTCAAATGGGCCTAACACTGCCACATGTATTATACTGGA
GTTGGCAAAGGCCTGTGACAATGAGATATCTCTCAAGCCTTTCACGCCTTTCCTCTATCAGAGAATGGCTCCCAC
ATGT 3184. chr8_HBII-276_CDBox_1.13068
ACAATGATGACTTAAATTACTTTTTGCCGTTTACCCAGCTGAGGTTGTCTTTGAAGAAATAATTTTAAGACTGAGA 3185. chr8_ENSG00000206853_snoRNA_1.12239
AGCCTCCTGGTGTTTAACACAGCTGTGTTCTTATACTGACTGTGTAGAAAGAGAAGGAAATAAACCTTACCCCAT
ATGCATTTCATCCCCGGACCCTGCACCTCGTCTATATTGTGAATAGGGAAATATGG 3186. chr8_hsa-mir-151_miRNA_1.11986
UCGAGGAGCUCACAGUCUAGU 3187. chr8_hsa-mir-937_miRNA_-1.20015
AUCCGCGCUCUGACUCUCUGCC 3188. chr8_hsa-mir-30d_miRNA-1.15544
CUUUCAGUCAGAUGUUUGCUGC 3189. chr9_hsa-let-7d_miRNA_ 1.30382
AGAGGUAGUAGGUUGCAUAGUU 3190. chr9_hsa-mir-31_miRNA_-1.24627
AGGCAAGAUGCUGGCAUAGCU 3191. chr10_U108_HAcaBox_1.18615
AGTTGTGGTGGTTTTCTTTTTGGCACATTTGTTAAGTTTTCAAATGGGCCTAACTCTGCCACATATATAATATCGG
AGATGGCAAAGGCTTGTGACGGAGATATCTCTCTTAAGCCTTTCCTGCATCAGAGAATGGCTCCCACATGT 3192. chr10_ACA19_HAcaBox_1.08483
GTGCACATTTCATTGACCTGCTTTCTTTTATGTGAGTAGTGTTATTTCTTATGTGCTATACAAATAATTGAAGGCTA
ATTAGCAGTATAACTATAAATAGTAATGCTGCCAGTCTCCTTCAGACAAAA 3193. chr10_hsa-mir-607_miRNA_-1.20511
GUUCAAAUCCAGAUCUAUAAC 3194. chr11_hsa-mir-548l_miRNA_1.231
AAAAGUAUUUGCGGGUUUUGUC

Figure 4-4

3195. chr11_ENSG00000201980_snoRNA_1.16939
ATTGCACGTTGTTGGAGCTTGGAGTTGGTGCTCTAACTGGCTGATAAACTTGCAAGTGTAGGTAGTATGCTATGT
GAGGGGCAAATTTTTCAGTAACATGACAAAGGTCTTTGGCCTAGTGAGTAGAGTTTGACAATAATCCTCGCTGCA
AGT 3196. chr11_U99_HAcaBox_1.13188
CCTCCTTTTCTTGGCGGGGATCGGGCTTGTGGTGCCGCTCCCCGTAATGTACGGAGGAAGAGGGAAAGGGCTCT
GGCCCCCTCGGCGTCATGTCTTCGGTGCTGGCGGCTTCCCATCCGCTGGTTCTATCCTCAAACGCCGGGACACCG 3197. chr11_ENSG00000212277_snoRNA_1.12722
ACAGATGATGAACTCATTGACAGACATACAGAGACTGTGTGCTGATTGTCATGTTCTGACTTA 3198. chr11_ENSG00000206976_snoRNA_1.12188
GGCCTCCTGGGATCCCATCTGGAAAGTGCTTAGTATTCTGCCTGCTTCACAAAGGGAGGGAAAGCAAACGTGGT
GAGGCACCCTTTCCATTCCAGCTTGCTCGGTAGCTGGTGATTGGAAGACACTCTGTGACAGCG 3199. chr11_ACA54_HAcaBox_ 1.11476
GAGCACTGTTCGTAACCCGTTAGCCTGGCTGTAGCTAATGGGTTCCATTCCGGTGCAATAGCATTTCCAGCGACA
CATGACTGACTGACTGGTGGCTTTCAGTTTCAGGTCTTGGAGACAAAT 3200. chr11_mgh28S-2409_CDBox_1.10388
GTTCAGATGATGAATTTAACTGTTCAACTGCTGAATGATAACGGGCATGAACTAAAACTTAATTCTGACAGAG 3201. chr11_hsa-mir-129-2 // hsa-mir-129-1_miRNA_-1.28449
AAGCCCUUACCCCAAAAAGCAU 3202. chr11_ENSG00000212551_snoRNA_-1.1303
AAGACTATACTTTCAGGGATCATTTCTATAGTTCATTACTAAAGAAGTCTATCTGAACATGTAGAACACATGACAC
CATAAGGAGGAGGCACAACATTCTCCCTAGAGCCTGAAGCTGGCTCTTGGTGTTTCATGACTACAGCAGCCATTT
GCCACTGATGACTGTTCTCTTCCAGGAGAATAAGAAGGAGAAGATGCAGTTTGG 3203. chr11_U28_CDBox_-1.12887
GTCAGATGATTTGAATTGATAAGCTGATGTTCTGTGAGGTACAAAAGTTAATAGCATGTTAGAGTTCTGATGGCA 3204. chr12_hsa-mir-331_miRNA_1.22856
CUAGGUAUGGUCCCAGGGAUCC 3205. chr12_hsa-mir-148b_miRNA_1.22081
AAGUUCUGUUAUACACUCAGGC 3206. chr12_hsa-mir-148b_miRNA_-1.1608
UCAGUGCAUCACAGAACUUUGU 3207. chr13_ENSG00000199282_snoRNA_1.12355
TGGCAAGCCTCCAGCGTGCGTGGGTCTGTGGTGATGTGTGCATTCCTACACTGCTTGCCAGAACAGTATTGAAAT
AGTGGAGCGTTTGTCCTGCTCCATCCAGAGCAAGGTTATAGAAATTTCAGACAATT 3208. chr13_ACA27_HAcaBox_1.10612
TACCCCCTTTTCACTTTGCCAGTTGGACTTATGTCTTTATTGGTCATTCAAGTGGGGCAAAGGAAATATCCTTTTA
AAACTCAGGCAAACTGGGTGTTTGTCTGTATCCTGTCAGAGGAAACAAAT

Figure 4-5

3209. chr14_hsa-mir-654_miRNA_1.2714
UAUGUCUGCUGACCAUCACCUU 3210. chr14_hsa-mir-541_miRNA_1.19625
UGGUGGGCACAGAAUCUGGACU 3211. chr14_U93_scaRna_1.12552
AATCTGTAGTCTTGGAGCCGCACAGGGTTGGTGGTACCCTCGAGCACACCAGACTTGCAGAAAAAGCATACTCC
AGAGGAAGCTGAGGCATGCCTGCTCGAGAGCCAGCTGTTCCATGTGCAATTTTCCTCTGATAGTTTCTGGTCACT
GTTGCCACGGTGATAATGACTGGGCTATGTCATTATCTATCCGCCAACAGTAAGAGAAGCTTTGCAGTCGAGATA
TTGTTTAGCAGATGGAGTGTTTTCTGTTGAACACTAAGTACTGCCACAAGT 3212. chr14_hsa-mir-543_miRNA_-1.26569
AAACAUUCGCGGUGCACUUCUU 3213. chr14_hsa-mir-432_miRNA_-1.26277
UCUUGGAGUAGGUCAUUGGGUGG 3214. chr14_hsa-mir-376a-2 // hsa-mir-376a-1_miRNA_-1.1976
AUCAUAGAGGAAAAUCCACGU 3215. chr14_hsa-mir-493_miRNA_-1.15138
UUGUACAUGGUAGGCUUUCAUU 3216. chr14_14q(II-4)_CDBox_-1.126
TGAGCCAGTGATGAAAACTGGTGGCATAGAAGTCAAGGATGCTGAATAATGTGTGTCTAGAACTCTGAGGTTCA 3217. chr15_ENSG00000199633_snoRNA_1.30231
ATGCAGGTACTGTTACAATATGACTGAAGTGATTTGTTGTCATTTCCCCTGCTTAAAGCCCTTGATATATAACTAT
CTCTGTCTAACTCATTCTGAAGTAAGACAGAGATGCTTGGTTTCATTTTT 3218. chr15_HBII-52-5_CDBox_1.14086
GGATCGATGATGAGAACCTTATATTGTCCTGAAGAGAGGTGATGACTTAAAAATCATGCTCAATAGGATTACGC
TGAGGCCC 3219. chr15_HBII-85-3_CDBox_1.13418
TGGATCGATGATGAGTCCCCCATAAAAACATTCCTTGGAAAAGCTGAACAAAATGAGTGAGAACTCATACCGTC
GTTCTCATCGGAACTGAGGTCCA 3220. chr15_HBII-52-41_CDBox_1.11431
GGGTCAGTGATGAGAACCTTCTATTGTCCTGAAGAGAGGTGATGACTTAAAAATCATGCTCAATAGGATTACGC
TGAGGCCC 3221. chr15_HBII-85-4_CDBox_-1.14266
TGGATCGATGATGAGTCCCCCCAAAAAAACATTCCTTGGAAAAGCTGAACAAAATGAGTGAAAACTCATACCGT
CGTTCTCAGCGGAACTGAGGTCCA 3222. chr15_HBII-438A_CDBox_-1.14261
GGATCGATGATGAGAATAATTGTCTGAGGATGCTGAGGGACTCATTCCAGATGTCAATCTGAGGTCC

Figure 4-6

3223. chr15_ENSG00000212604_snoRNA_-1.13849
TGCCCCTGACCTGGGAAGAGAGGGGCCTGGCTGGTGGTATCCATCTCATACCAGCTAGGGATGAAGAAACCGC
TTGCTCATCCCAGCCTGGCTCCTGGTCTATGCCCATGCCTGGTTCGTGCCTTGGACATATCA 3224. chr15_ENSG00000212528_snoRNA_-1.11412
AAGACAACGTAAATATATGTATAAAGAGTATCTTCAGGAGACGTAATAATGTAAAAATCATGCTCAATAGAATTA
AGCTGAGGCTC 3225. chr15_HBII-52-21_CDBox_-1.11103
GGGTCGATGATGAGAACCTTATATTTTCTGAAGAGAGGTGATGACTTAAAAATCATGCTCAATAGGATTACGCT
GAGGCCC 3226. chr17_hsa-mir-22 miRNA_1.21361
AGUUCUUCAGUGGCAAGCUUUA 3227. chr17_U49B_CDBox_1.12667
CTGATGATACTTGTAATAGGAAGTGCCGTCAGAAGCGATAACTGACGA 3228. chr17_hsa-mir-1253_miRNA_-1.13437
AGAGAAGAAGAUCAGCCUGCA 3229. chr18_ENSG00000199856_snoRNA_-1.13078
AAGACTATACTTTCAGGGATCATTTCTATAGTTCATTACTAGAGAAGTTTCTCTGAATGGGTAGAGCACTGGAAA
CCATGAGGAGGAGGCACAGTGTTCTCTCCTGAGCATGAAGCTGACTCTTGGTGTTGCTTCACTGCACCTGCCATG
TGCCACTGATGATTGTTCTTGTCTTCCTCTGGGAGAGTAAGACGGAGAGCATGCAGTCTGAGTG 3230. chr18_ENSG00000199856_snoRNA_-1.12167
AAGACTATACTTTCAGGGATCATTTCTATAGTTCATTACTAGAGAAGTTTCTCTGAATGGGTAGAGCACTGGAAA
CCATGAGGAGGAGGCACAGTGTTCTCTCCTGAGCATGAAGCTGACTCTTGGTGTTGCTTCACTGCACCTGCCATG
TGCCACTGATGATTGTTCTTGTCTTCCTCTGGGAGAGTAAGACGGAGAGCATGCAGTCTGAGTG 3231. chr19 hsa-mir-99b miRNA 1.22661
CAAGCUCGUGUCUGUGGGUCCG 3232. chr19_hsa-mir-520c_miRNA_-1.22238
CUCUAGAGGGAAGCACUUUCUG 3233. chr19_hsa-mir-523_miRNA_-1.19767
CUCUAGAGGGAAGCGCUUUCUG 3234. chr19_hsa-mir-516a-1 // hsa-mir-516a-2_miRNA_-1.13252
UGCUUCCUUUCAGAGGGU 3235. chr19_U105_CDBox_-1.10671
CCCCTATCTCTCATGATGAACACATATGCCTCTGAGCTGCTGTGATTTCTGGCTTCAAAGTAAACGCTCTGAAGAA
GAGATGGGG 3236. chr20_hsa-mir-499_miRNA_1.2299
AACAUCACAGCAAGUCUGUGCU

Figure 4-7

3237. chr20_U71b_HAcaBox_1.17112
TCCCTGTATTCGAAAGTGATCGTGGGCTGCCTTTGCCCTGGTCATTGATAGTGCAGGGAGAGGAATCAATGAAA
GCGCTTCCCCGTGTTTGAAGGGTCCACTCCTATCCCTTCCAAACTCTGGAGCTTTCGTACATGC 3238. chr21_ENSG00000207147_snoRNA_1.18521
GCCCGCCTTGGCCTCCCAAAGTGCTGGGATTCTTACATCGACTGCATAGAAAGAGGAGAGAACATAACCTACCT
ACCCCGTACATACTTCAGCCCAGGTCCTGTGCCTCATCTGTAATATGAATGAAGAGACATGG 3239. chr22_hsa-mir-1286_miRNA_1.29375
UGCAGGACCAAGAUGAGCCCU 3240. chr22_hsa-mir-185_miRNA_1.17568
AGGGGCUGGCUUUCCUCUGGUC 3241. chr22_ENSG00000199783_snoRNA_1.15181
CCGCAGTGACAGCAATATTTTTCATCCACAGTTCACCTCATGAATGTTGTCACTTTGGGTCTGAGTGA 3242. chrX_hsa-mir-548m_miRNA_1.1709
CAAAGGUAUUUGUGGUUUUUG 3243. chrX_ENSG00000202231_snoRNA_1.15569
TAGCAAGCCTCCAGCATGCTTAGGTCTGCAGTGACCCTATGCATCCCTACAGTGCTTGCCAGAACAGTTTTGAAA
CGGTTTGAGGCCTTGCCCTGCTCCATCCAGAGCAAGGGTATAGAAATTTCAGACAATT 3244. chrX_ENSG00000200620_snoRNA_1.08742
TACCTCCCAGGATGGCATCTGGAAGTGGATAGTATTCTGCCAGCTTTGGAAACTGGATGAAAAGCAAATCTGGC
AGAGGTACCCATTTCATTCCCAGCTTGCTCAGTAGCTGGTGATTGGAAGAAACTCTGCAACAGTG 3245. chrX_hsa-mir-98_miRNA_-1.28828
UGAGGUAGUAAGUUGUAUUGUU
3246. chrX_hsa-mir-450b_miRNA_-1.22073
UUUUGCAAUAUGUUCCUGAAUA 3247. chrX_hsa-mir-505_miRNA_-1.21463
CGUCAACACUUGCUGGUUUCCU 3248. chrX_hsa-mir-1277_miRNA_-1.19411
UACGUAGAUAUAUAUGUAUUUU

Model 2

Model 3

Fig. 13 – SEQ ID NO: 3249

ATP5O-Hs04272738_m1 NM_001697.3 756BP

1 ctcttcccac tcgggtttga cctacagccg cccgggagaa gatggctgcc ccagcagtgt
61 ccgggctctc ccggcaggtg cgatgcttca gtacctctgt ggtcagacca tttgccaagc
121 ttgtgaggcc tcctgttcag gtatacggta ttgaaggtcg ctatgccaca gctctttatt
181 ctgctgcatc aaaacagaat aagctggagc aagtagaaaa ggagttgttg agagtagcac
241 aaatcctgaa ggaacccaaa gtggctgctt ctgttttgaa tccctatgtg aagcgttcca
301 ttaaagtgaa aagcctaaat gacatcacag caaaagagag gttctctccc ctcactacca
361 atctgatcaa tttgcttgct gaaaatggtc gattaagcaa tacccaagga gtcgtttctg
421 ccttttctac catgatgagt gtccatcgcg gagaggtacc ttgcacagtg acctctgcat
481 ctcctttaga agaagccaca ctctctgaat taaaaactgt cctcaagagc ttcctaagtc
541 aaggccaagt attgaaattg gaggctaaga ctgatccgtc aatcttgggt ggaatgattg
601 tgcgcattgg cgagaaatat gttgacatgt ctgtcaagac caagattcag aagctgggca
661 gggctatgcg ggagattgtc taaaagtgtt ggttttctgc catcagtgaa aattcttaaa
721 cttggagcaa caataaaaag cttccagaac agatca Fig. 14-1 – SEQ ID NO: 3250

DOP1B-Hs01123288_m1 NM_005128 7689BP

1 tcccacagtg cctggcccag aagccttgct aaatatttga acaggattgc ccaatacttt
61 tctgctgtga gaatgtaaga tggatccaga agagcaggag ctcttaaatg attacagata
121 cagaagctac tcttcagtga ttgaaaaggc tttgagaaat tttgagtcct cgagtgaatg
181 ggcggatctc atatcttcac ttggcaaact caacaaggct cttcagagta acctgaggta
241 ctccttgttg ccaagacggc tcctcatcag caaaagatta gctcagtgtt tgcaccctgc
301 cctgcccagt ggtgtccact taaaagctct ggaaacctac gagattatct ttaaaatcgt
361 ggggaccaaa tggctggcca aggacttgtt tctgtacagc tgcgggttat ttcctctcct
421 ggcacacgcg gcggtgtcgg tgaggccggt gctgctcacc ctgtacgaga agtacttcct
481 cccactgcag aagctgctcc tgcccagtct gcaggccttc atcgtgggcc tgctgcccgg
541 ccttgaagag ggctccgaga tctccgacag aacggatgct ctgctcctga gactgtcgct
601 ggtggttggc aaagaggtgt tttacaccgc cctctggggg agcgtcctgg ccagcccgtc
661 catccgcctc cctgcctcag tcttcgtggt gggccacatc aacagggatg cccccggccg
721 ggagcagaag tacatgctgg ggaccaatca ccaactcacg gtgaagtctt tgcgtgcctc
781 cctgttggac tcaaatgttc ttgtgcaaag aaataatctg gaaatcgttc tgtttttctt
841 cccattttat acctgtctgg attccaatga gagagccatc cccctcctca gatctgacat
901 cgtgcgcatt ctctcagccg ccacccagac cctactgaga agggacatgt ccctgaacag
961 aagactgtat gcatggttac taggctcaga cataaaagga aataccgttg tgccagaatc
1021 tgaaatctca aattcttatg aagaccagtc gtcttatttt tttgaaaaat actccaagga
1081 tcttttagtt gagggtttgg ctgagatatt gcatcagaag ttcatagatg ctgacgtgga
1141 ggaacgccat catgcatacc tgaagccttt tcgcgtcctc atcagtctgc ttgacaagcc
1201 agaaataggg cctcaagtgg ttgggaattt gtttctcgaa gtcatcaggg ccttttattc
1261 ttactgcaga gatgcccttg gctctgatct taaacttagc tacacccaga gtggaaattc
1321 gctgataagt gcaatcaagg aaaacagaaa tgcctctgag attgtcaaaa cggtaaattt
1381 gctgataact tctctaagca cagactttct ctgggattat atgacaaggt gttttgagga
1441 atgctttaga ccagtgaagc agcgttacag cgtgaggaac agcgtcagcc ctcccccac
1501 ggtctcggag ctctgcgccc tcctggtctt cctgctggat gtcattcctt tggaacttta
1561 ctctgaggtg caaacccagt atctccctca ggtgctcggc tgcctggtgc agcctcttgc
1621 tgaggacatg gaggccttaa gtttacctga actcacgcat gccttgaaga cgtgtttcaa
1681 ggtgctcagc aaagtccaga tgcctccttc ctacctcgac acggagtcca ccagcggaac Fig. 14-2 – SEQ ID NO: 3250

1741 ctcgagtcca gtaaaaggtg aaaacggcaa aataattttg gaaacaaagg cagtgattcc
1801 cggtgacgaa gatgcttcgt ttccccctct gaagtctgag gacagtggga tcgggctcag
1861 tgcctcgtca ccggagctct ctgagcactt gagggttcct cgagtttctc tggaaaggga
1921 cgacgtttgg aagaagggcg ggagcatgca gaggacgttt ctttgcatcc aagagctaat
1981 cgccaacttt gccagcaaga acatttttgg agtacagctg acagcgtcag gagaagaaag
2041 caagtccgag gagcctgcag ggaagaggga cagggatggg acgcagagcc tggcagccaa
2101 tgattccagc aggaagaact cttgggagcc caagcccatc actgtgcctc agttcaagca
2161 gatgctgtca gacttgttca cagcacgagg gtctccattc aagacaaaaa gttcagagtc
2221 accatcgtct tcgcccagca gccctgccag gaaaaacggg ggagaatggg atgttgagaa
2281 ggtggtcatt gacctggggg gttccaggga ggaacgcagg gaggcctttg ccgccgcctg
2341 ccacctgctg ctggattgtg ccactttccc tgtctacctg tccgaggaag agaccgagca
2401 gctctgtgca acgctcttcc agctgccagg agccggtgat tccagttttc catcttggct
2461 gaagtccctc atgactattt gctgctgtgt gactgactgc tacctccaga acgtggccat
2521 ttccactctg ctggaagtga taaaccattc ccagtccctg gcgcttgtca ttgaagacaa
2581 gatgaaacgc tataagagct ctggacacaa cccttttttt ggcaagctgc agatggtgac
2641 ggttcctccc attgctccag ggatattgaa agtcattgca gagaaaacag atttctatca
2701 gagggtggct cgtgtgcttt ggaatcagct gaacaaagag acccgggagc atcacgtcac
2761 ctgcgtagaa ttgttctacc ggctgcactg cctggcccct acggccaaca tctgcgagga
2821 catcatctgc catgccctcc tggaccctga caagggaaca aggctggaag ctctgtttag
2881 attttccgtg atctggcatc tgacaagaga gatccaaggc agtcgagtaa catctcacaa
2941 tcgctccttt gataggtcct tgtttgtcgt gctggacagc ctggcctgca cggatggtgc
3001 catcggtgcg gcagcccagg gctggctggt gcgtgcgctc tccctcgggg acgtggctcg
3061 catcctcgaa cccgtgctcc tgctgctgct gcagccaaaa acccagagaa cctccatcca
3121 ctgcctcaag caggagaact cggccgatga cttgcaccgt tggtttaaca ggaagaaaac
3181 ctctttcaga gaggcatgcg cagtgcccga gcctcaggag agcggctctg aagagcacct
3241 gcctctgagc cagttcacca cagtggaccg tgaagccatt tgggccgaag tggagaagga
3301 gcccgagaag tacccgctgc gaggcgagct gagcgaggaa gagctgccct actacgtgga
3361 gcttccagac aggacggccc acggcgcccc ggacagcagc gagcacaccg agtctgcaga
3421 tacaagctcc tgccacacgg acagcgagaa cacgtcctcc ttctcctccc cttcccacga
3481 cctgcaggag ctgagcaacg aagagaactg ctgtgcaccc atccccatgg ggggcagggc
3541 gtaccccaag cgctcggccc tgctggcggc cttccagtca gaaagcttca aggctggggc
3601 caagttaagc ctggtgcggg tggactcgga caagacgcag gcttctgagt cgttctccag
3661 cgacgaggag gcggacttgg agctccaggc cctcaccaca tccaggctgc taaagcagca
3721 gcgggaaagg caggaggccg tcgaggcctt gttcaagcac atcctgctct acctgcagcc
3781 ctacgactct cggcgggtcc tctatgcctt ctcggtgctg gaggctgtgc tcaaaaccaa
3841 ccctaaggaa ttcatcgagg ctgtgtccag gactagcatg gataccagct ccaccgcgca
3901 cctcaacctc atctccaacc tcctcgctcg ccaccaggag gcccctcattg gccagagttt
3961 ctacggaaag ctccagaccc aggtccccaa cgtgtgcccc cactctctgc tcctggagct
4021 gctcacctac ctctgcctga gcttcctgcg ctcctactac ccttgctatt tgaaggtctc
4081 gcaccgagac attctcggca accgggacgt gcaggtcaaa agtgtcgagg ttttgatcag
4141 gataatgatg cagctggtct cagtggccaa gtcttcggaa gggaagaacg tggagttcat
4201 ccacagcttg ctgcagaggt gcaaagttca ggagtttgtc ctgctctccc tgtcggcgtc
4261 catgtacacg agccagaagc gctacgggct ggccaccgcc caccacggca gggccctgcc
4321 agaggacagc ctctttgagg agagtctcat taacttgggt caggaccaga tctggagtga Fig. 14-3 – SEQ ID NO: 3250

4381 gcacccgctg cagattgagc tgctgaagct gctgcaggtg ctgattgtct tggaacacca
4441 cctgggtcgg gcccatgagg aggcggaaaa ccagcccgac ctgtcccggg agtggcagag
4501 agccctgaac ttccagcagg ccatcagcgc cctgcagtac gtgcagcccc accccctcac
4561 ctcccagggt cttctggtct ctgcggtggt gaggggtctg cagcccgcct acggttacgg
4621 catgcatccg gcctgggtga gcttggtcac gcattccttg ccctacttcg gaaagtccct
4681 gggctggacg gtgacaccct ttgttgtcca gatttgcaaa aacttggatg acttggtcaa
4741 gcagtatgaa agcgaatctg tgaagctctc tgtcagcaca acctccaaga gggaaaacat
4801 ttctccagat tatccactca cccttctaga aggtctaacg accattagtc atttttgtct
4861 tttggaacaa gccaaccaaa acaaaaagac catggctgca ggtgatcctg ccaacttgag
4921 gaatgccaga aatgccattt tggaagagct gcctcgaact gttaacacca tggcccttct
4981 ctggaatgtt ctcagaaagg aggagactca aaagagacct gtcgatctcc taggggccac
5041 gaagggatcc tcttccgttt actttaaaac caccaaaacc ataagacaaa aaattttaga
5101 cttcttaaac cccttgacgg cccatcttgg ggttcagttg acagcggctg ttgcggcagt
5161 gtggagcaga aagaaagccc agcgtcacag taagatgaag attatcccaa cggcaagtgc
5221 atcccagcta accettgtcg acttggtgtg tgcactcagc accctgcaga ctgacacgct
5281 gctgcacctg gtgaaggagg tggtgaagag gccaccccaa gtcaaagggg gtgatgagaa
5341 atcgccccta gtggacattc ctgtgttgca gttttgctat gcttttctcc aaaggctccc
5401 agtaccagcc ttgcaagaga acttttcttc actgttggga gtattgaaag agtctgtaca
5461 gttgaatcta gccccacctg ggtatttttct gcttctcagc atgctgaatg actttgtaac
5521 aagaactccc aacctggaaa acaagaagga ccaaaaagac ctgcaggaaa tcactcagaa
5581 aatcctagaa gctgtgggga acattgccgg ctcttccttg gagcaaacca gctggctaag
5641 cagaaacctg gaagtgaagg cccaacctca ggcctctcta gaagaatctg atgctgagga
5701 ggacctgtat gatgctgctg cagcttcagc aatggtgtct tcatccgccc cgtcggtgta
5761 cagcgtgcaa gccctctctc tcctggcaga ggtactggct tccctcctgg acatggttta
5821 tcgaagtgat gagaaggaga aagctgtgcc gttaatctcc cgtctgcttt actatgtttt
5881 tccatactta cgcaaccaca gtgcctacaa tgctcccagc ttccgggctg gcgctcagct
5941 gctgagctcc ctgagtggct atgcctacac aaagcgagcc tggaggaagg aggtcctgga
6001 gctgtttctc gaccccgctt tctttcagat ggatacttcc tgtgttcatt ggaagtccat
6061 tattgaccat cttttgactc atgagaaaac aatgtttaag gatttaatga acatgcagag
6121 cagttctttg aaactattct caagttttga acagaaagcc atgctgttaa agcgccaggc
6181 ttttgctgtc ttcagtggag aacttgatca ataccacctt taccttccac tgatacaaga
6241 acgcctgaca gacaatctca gagttggaca gacatccata gttgctgctc agatgtttct
6301 tttttcaga gttttgctgc taagaatatc tcctcaacat ttgacttcat tgtggccaat
6361 aatggtctct gaattgattc agacattcac acagcttgaa gaagatctaa aagatgaaga
6421 tgagtcattg agaagcacca acaaagtaaa cagaacgaaa gtttcagtcc cggatgcaaa
6481 tggaccctca gtgggggaga taccccagag tgaactcatc ttgtatttat cagcttgcaa
6541 attcttggac acagcgcttt cttttccacc tgacaagatg ccattatttc aaatttatag
6601 gtgggcattt attccagaag tggacacaga gggccctgcc ttcctgtcgg atgtagagga
6661 gaatcaccaa gaatgcaaac cccacactgt caggattcta gaacttctaa aattaaagtt
6721 tggggaaatc agtagctctg atgagatcac catgaagagt gaattcccgc ttctgcgcca
6781 acattctgtt tccagcatca ggcagttgat gccattcttc atgactctaa atggtgcatt
6841 taagacccag agacagctgc ctgctgatag cccaggaact ccattcttgg actttcctgt
6901 cacagatagc ccaaggatct taaaacaact ggaagaatgc atcgaatatg attttctgga
6961 acatccagaa tgttaaccat gtgagagaga atatgtttaa tccatgtatt ggtactttac Fig. 14-4 – SEQ ID NO: 3250

7021 tgaaaaccag gttatattct aaagaagaaa gaaggcagga tagtgctttt gaacaagcct
7081 atttccattt tgaaagtaga tttcaggcta ggtgcggtgg ctcacacctg taatctcagc
7141 actttgggag gccaaggcag gcagatcact tgaggtcagg agttcgagac cagcctgacc
7201 aacatggtga gaccctgtct ctactaaaaa tacaaaaatt agctgggtgt ggtggcggcg
7261 cctgtaatcc cagctacttg ggaggctaag gcatgagaat tgcttgaacc caggaggtgg
7321 aggctgcagt gagccgagat cacgacactg cactccagct gtgtgacaga atgagaccat
7381 ctccaaaaaa aaaaaaaagt agatttcaga taatttactg ttcagcaaca ggacacacct
7441 ccctaaatgc cttgtaatat atttgaatct gattctgcat ttcttcctca atttatgtaa
7501 tgaaaataaa attaatatat catctaacag tagcacaaaa tttgtaatat gaagtaaagt
7561 atgaagataa tgaagaagtt gttttctttg ttgaagcagt tatatgggtc tttctcagta
7621 tatttctctt ttctctaaaa gtttaaactt attaaaagaa tgttattttt aacctttcaa
7681 aaaaaaaaa Fig. 15-1 – SEQ ID NO: 3251 – NCAM2 - NM_004540.5 - 8041 bp 1 actttgcgag gaggagcgcg cgggctgcgg gcggctgggg caccgcggga gcggcggcgg
61 cggctctagc agaggcggcc ggggcagcga aaggttctct ctccagggct ggacttaata
121 actttgaaac tgtccaccgg tgtcacgtcc tgaacatgag cctcctcctc tccttctacc
181 tgctggggtt gcttgtcagt agcgggcaag ctcttcttca agtgacaatt tcacttagca
241 aagtagagct tagtgttgga gaatctaaat tcttcacatg tacagcgatt ggtgaacctg
301 aaagtataga ttggtataat cctcaaggag agaagataat ttcaacacag agggtagtag
361 tgcaaaagga aggtgttagg tcacggttaa ccatctacaa tgcaaatata gaagatgcag
421 ggatatatcg ttgtcaagca acagatgcca aaggacaaac acaagaagct acagtagttt
481 tggaaattta ccaaaaactc actttcagag aagtggtatc tccacaagaa ttcaaacaag
541 gagaagatgc agaagtggtt tgccgagtta gcagttcacc tgcacctgct gtcagctggt
601 tgtatcataa tgaggaagtc accactattt ccgacaatcg gttcgctatg ttagcaaaca
661 ataacctgca gattctcaac atcaataaaa gtgatgaagg tatatacaga tgtgaaggaa
721 gagtggaggc caggggagaa attgacttcc gtgatatcat tgttattgtt aatgtgccgc
781 cagcaatctc aatgcctcag aaatctttta atgccacagc agagagagga gaagaaatga
841 cattttcctg cagggcctca ggctctccag aacccgccat ctcctggttc aggaatggca
901 agctcattga agaaaatgag aagtacatat tgaaagggag caatacagaa ctcactgtca
961 ggaacataat caatagtgat ggtggtcctt atgtctgcag ggccacaaat aaggcaggag
1021 aagatgaaaa gcaagctttc ctccaagtct ttgtacagcc tcacataata cagcttaaaa
1081 atgaaactac atatgagaat ggtcaagtca cactcgtatg tgatgcggaa ggggagccta
1141 ttccagaaat cacttggaaa agagctgtgg atggcttcac gttcactgaa ggcgataaga
1201 gcctggacgg ccgtatcgaa gtcaaagggc agcatggaag ctcatcactg catattaaag
1261 atgtgaagtt gtcagattca gggagatatg actgtgaagc tgcaagcaga attggagggc
1321 atcaaaagag catgtacctt gatattgaat atgcccccaa gtttatatca aaccaaacaa
1381 tttattactc ttgggaagga aatcctatca atataagttg tgatgtgaaa tcgaatccac
1441 cagcatcaat tcactggaga agagataaat tagtcttacc tgctaaaaac acgaccaatt
1501 taaagactta tagtacagga agaaagatga tattagagat tgcacctaca tctgacaatg
1561 actttggacg ctataattgc acagccacta atcatatagg aacaagattt caagaatata
1621 ttcttgcttt ggctgacgtg ccatccagtc cctatggagt gaagatcata gagctgtcgc
1681 agaccacggc caaggtttcc ttcaacaaac cggactccca tggaggtgta cctattcatc Fig. 15-2 – SEQ ID NO: 3251

1741 actatcaggt ggatgtcaaa gaagtagcgt cagaaatctg gaaaattgta cgctcccatg 1801 gagttcaaac aatggttgtt ttgaacaacc tggaaccaaa tacaacttat gaaatcaggg 1861 ttgcagctgt aaatggaaag ggacaaggag actacagtaa aatagaaatc ttccaaacat 1921 taccagttcg tgaaccaagt cctccatcca tacatggaca gccaagcagt ggaaagagct 1981 ttaaactcag catcaccaaa caggacgatg gaggggcccc tattttggaa tacattgtga 2041 aatatagaag taaagataag gaagaccaat ggctagagaa aaaagtgcaa ggaaataaag 2101 accacatcat tttggagcat ctccagtgga ccatggggta tgaagttcag attacagctg 2161 ccaatagatt gggatattct gaaccgacag tttatgaatt cagcatgcca ccaaagccca 2221 acattattaa agacacgctg tttaatggtc ttgggcttgg agcagtaatt ggcctgggag 2281 ttgctgcact gctgctaatt cttgtggtaa cagacgtcag ctgcttcttt attcggcaat 2341 gtgggttgct gatgtgcatc actaggagaa tgtgtggaaa gaaaagtggc tccagtggca 2401 aaagtaaaga actcgaagaa ggaaaagctg catacctgaa agatggatca aaagaaccaa 2461 tagtggagat gagaacagag gatgaaagag ttactaatca cgaagatggg agcccagtaa 2521 atgagccaaa tgaaaccaca ccactgacag aacctgaaaa attgccttta aaggaagaag 2581 atgggaaaga agctctaaat ccagaaacta tagaaattaa agtttctaac gacatcattc 2641 aatcaaaaga agacgacagc aaagcataac aacaatatta caggggcttg aacaacacta 2701 cgaagagtat ttggattgcg tgaccctatg accaaaacta ttccattgac cttaatttct 2761 tgggaaactt ctagcttgga atagcttgta cacatataca tatgatcaaa tactcctgcc 2821 catgatccat tcccttttgt tattgttgtt gttgttgctg ttgttgttaa ttttgttaag 2881 aatttcaata tcaagactga ctggcaccaa cactttggta ttcaatttga ttctatgact 2941 gaagtactgg aatttattat gtggctaaag tgctctattt attaagaact atatttaata 3001 ccaccaacaa atataggggt taaggaaaaa aaacgtgagc tacatgtgta agaaggccct 3061 gcatgtgtat gagtcctatt ctgggcaaat agattcttaa agtggctttc aacttcaaga 3121 tgaaggagct taataatggt tactcatttt atcaggggaa tttcagggaa cgtaggcgtc 3181 aaagagccag ttatctttag cagatattaa aaattgaaaa ctttggagaa ctcatttcaa 3241 gttatgattc agtgcatttt caacattgat ttttgataga ctgaagtgcc agatcaaaat 3301 tgttacccat ttgaaagaat attagttgta tataaaatta gattagaaag actttctaaa 3361 tctctatctc tttatatatg tcctattcat tcacaatgga ttatacaaaa aaaagtgtat 3421 tgcaagtgaa ataatattga tttctgccct cagcttcaaa taaagtaaat tgaaatggga Fig. 15-3 – SEQ ID NO: 3251

3481 acaatatcaa tatggtgtct tgatatattt ataaatatgt gattatcatt tatttttaaa 3541 ataatttatc aaaaaacaag tctttagtgt tcaaatactt caaatcatat cctcagatat 3601 atttttagcc catggtttta tataatcttt aagaactaat tttaccactg ttataggttc 3661 accattaaat ataattggct aataaaaatt ttaaggttga ctaaattaag aagaaattat 3721 ttaacatttt aatgtgccat aaaagagtaa atgataaata attaaatgcc actatgtgtt 3781 ctattccgga tgttctagct agaagtcatt ttaagatttt gataaacaac tttggttgaa 3841 gaaattcctt aagtattcaa cacaaacttt ctaatatctt ttgttagggt tataccagaa 3901 taaaatgctt ctttacttcc aagctatgca agctcccaga ggtaatagag tgacacatga 3961 tttaacttat atgtaaggtt taaaaaagta tttatcatta taaacataca taccatttgg 4021 gagcaggttt attaaccttg agagccaaag gtttccttag gccctgtaac attcagaacc 4081 tttggtgttt caggtggtat tatagctcaa atagtgacag gacagggaat gcgttccaaa 4141 ggaatattgg agcaatttta acattgcaga aacctgctct gggtgtgtct ctctgtagag 4201 ataacctgat gattattaaa tgtaaaatta aggcaactca tgaatatttt tatttacaaa 4261 gtgcttgaaa ctcagccaag gagagaaaac taagtacttt tatataattc atcacttttc 4321 tggctacagc aggacagaat atgaccatct tcgtttgaag gcaccaaatc gtcgcagtgt 4381 ctttgccata agttgcaggg ttaaatgcgg gaatctctcc ttgcgttcct gtctggcgta 4441 ttctgaagaa aagaacagaa ttcttgtgcc tacctaagaa tttgagtagt gtctaaacaa 4501 acaaagcagt taggtcattt taactgactt gattatccaa ctggtctttg acagatttga 4561 ctgttcatat ttagtttatg tttgtctgat catccagttt gctttatttt gctgtgtttt 4621 attttgttgt ttgttttgtt ttgtaccagt gtactaaaac tagtcaaaat acttgaatta 4681 gtttgtttgt gcaaagtgta caagcttagt aaagtgtcca tgaagcaata gccatgaatg 4741 ctaattattt ctaaataggg ccacatggtt ttaaactaat gatggtgaaa gaaatacgat 4801 gactgagaaa gtcatttcgc atgtttacta ttgttatatt cgtgctttac ttcaagagtg 4861 cagaaatcat aataaataac aaactatttt tgtgttttct caatgtgaca tttctgtttc 4921 tctcatttat tcggattttc cttgtaaaga aattgacata tatttcatat atatatacac 4981 atatatatat atacacatat atatacatat atatatatga tgttaaattt cctgccactc 5041 atgtggagta atgatctgaa attaacagat aatctgaagc taattatatt cagactattt 5101 caagtgcact gtttcagttg cccgggtggt ccttacctct tgtccttgaa atccatgcca 5161 tgctgaagca aggcaatact gtgataaagt atttttttta atatttcaat ggaatgctcc Fig. 15-4 – SEQ ID NO: 3251

5221 aaatgattta taaaaatttc aaaataaaag atggcttgta gtaaattgta aaatatgagt 5281 agaactgaaa taacctgttt cattcttatt ctagattaaa caaacatata catataacca 5341 tataaatgtt atttttattg tctgagagta ctcttaaata ttagtataaa gtgtcaaaag 5401 aattgactga atataagtac tgttaaaata atttgaaccc tatgatattt taaaccaaga 5461 ggcaaagata tcacctaaaa cttggtattt cttgataggt taggtgcaat taggcagtga 5521 caatctgtat tcaacaacat ataagaggaa agagtaatat cagaattttg acacaaatta 5581 atgtgtcaac atattttaca atgattgtca aaggaattta agaattgtat ttttaaagat 5641 ttatttatta tttttgtggg ctaagacatt gccattctat tgatactaat gtctaacatt 5701 aatgtttctt gttttctttt atttttaata ttaataacta taaaagcatt tttcaaaggc 5761 tatttgatcc agcacacttc atatggatct tagtctttga attaaatatt tatataaata 5821 gattttatta atcaaattat ttatttgtgt gccaacaatt aattgtaact ttatgatcat 5881 atctttgttt atgcttctta ttttaaataa ttaagatgta tctgtgcctt ttaattagca 5941 tgacagtctg ctttattaaa agaaaaaaac tacaattaac atcattacta gtatattttg 6001 cttagatttg agatactcaa atgatgctgt cttatttaca gtcagtaatt aagttcaatt 6061 caaactattt taccttgaat ataaaatcta aatataataa actatactgt ataatttact 6121 ttaattcatg tcaaaacaat tctttttata cacacacatg aaatattctt aatctgttct 6181 gtattgtttt tctaaacaat aaatacattc tagatattgt tgaaattaaa ttttgccagt 6241 tgtaagacaa agacaacaga taacttttga aaatcaagca aattactatg gtgtttcttg 6301 ggtcttcatt attccattta tatatatttt ttatttcgaa taataaatca acctttattt 6361 ttggcaataa gattatcact gacgaaaata tgtacagttc aagaagtaga aataatattt 6421 tccattagtt aatttaggaa atattggaat agcatattat aattatttat gaggttccca 6481 atgttgtttt tcacagaaaa taaggtaaac attcaactta aatcccccat gaagtttttt 6541 catgctcata ctcataatca ttatcacata atgtgcttat tcaacaaact ttgtatctgg 6601 atatattttt aacaataagt ttgttagcat tatttattta tctttagaga gaaaatattt 6661 gcatctgttt atttaccctt tgaagcatta atacttagtc actcacattg aaattgcata 6721 tggatgtatc aacataggct aaaattaaat tatggatgtc gcagaaatga aatacttcat 6781 cttagaaggt aaaattttca agaaagtatt ttattcatgg acttaataat gtcttaagat 6841 gaaacaattt tatgtccaaa tgagaaattt ataaaaagac ccacatatag tagttgctga 6901 acaaacataa ttttcttcca gctcccatcc ttcctttttg aaaaattgaa tttacccatg Fig. 15-5 – SEQ ID NO: 3251

6961 tagatgcagc tatttacaat tatacaagaa tgcgaataga ttaattatat cttctcatat 7021 aaaggcaaag aattttatat tatatataat gctaaatatt tatttgataa cacaatattc 7081 ttagaaaaat agtttattac tttaggattt tatctataac ataaatatat tatttgttat 7141 tacctcttta aattttcatt ttatacaatt tttgagattc tggccacaca acattcagaa 7201 ttattgctca tgtaaattta aatattgcta cttatttttt ttcttttctg aaatgaaaac 7261 atgaatcttt tggcatctgt ttttagcctc ccatggaaga cagtaagcaa aaccatcact 7321 gttggagaat ttcaaatcac aacccgacat aggagagtag agaaacaaag aaatgagtgg 7381 atctagaaag gcaaactgaa ttgctatatt tggaatagct aagaaggacc tgactttgag 7441 aagtgctaga ccagggacta ggaacgttgc ttagataaaa attatggccg attacactga 7501 tgcgaaggag aaaacagtgt aacacagagg agaaagttaa cagagataga atctatgatt 7561 taattttgca aatagttttt ttagagaaca acatgcatac tataaaagaa atgatactat 7621 taagaacaaa cctacttgtt ccaactctta aagaaatatt catggtttag catttgcctc 7681 taaaccctgt tagaaatatg tgaagttaga aataaaggtt tttttaaaaa aaaagctttt 7741 ttggtatgtg aactgtatgc tgtgctcagt atgtactgaa acatactatc ttttattttc 7801 tttaatttat atattccatt caaattctat attcttaagt tagctaccac aacgttttct 7861 tattgtttca atatggtatg tcccaatgaa atgctgtata tatatgtcta aactgtaaaa 7921 attatactgc aaatgttgaa gttttgtatt tatgagagac attgaaagta tggcttacag 7981 tatatcaaac ttgtcacact tcaccatttg tatattaata gtaaagatac ttttacttta 8041 a Fig. 16– SEQ ID NO: 3252

UBASH3A-Hs00955169_m1 NM_018961.4 2520BP

1 atttctgtgt gcaggcgagc ttcttggcct aagggcagga agagatggca gcggggggaga
61 cgcagctcta cgccaaggtc tccaacaagc tcaagagccg cagcagcccc tcgctcctgg
121 agcccctcct ggccatgggc ttcccggtgc acaccgcgct gaaagcgttg gcagccacgg
181 ggaggaagac ggcggaggag gccttggcct ggctgcatga tcattgcaat gaccccttccc
241 tagacgaccc catcccccag gagtatgccc ttttcctctg tccaacgggg cccctgctgg
301 aaaaacttca agagttctgg agagagagca agcgccagtg tgcaaagaac agagctcatg
361 aggtcttccc acacgtgaca ctctgtgact tcttcacgtg tgaagaccag aaggtggaat
421 gcctgtacga ggcgctgaag agagctggag acaggctcct gggctccttc cccacggccg
481 tgcctctggc tctccactcc tccatcagct acctcggctt cttcgtcagt ggcagccccg
541 cagacgtcat ccgggaattc gccatgacct tcgccacgga agcatctctc ttagcaggca
601 cttccgtttc ccgcttctgg attttcagcc aggtgcctgg acatggccct aacctgaggc
661 tgagcaattt aactagagcc tccttcgtga gccactacat ccttcaaaaa tactgctccg
721 tgaagccttg caccaaacag ctgcatctga ccttggccca caagttctac ccccaccacc
781 agaggacgct ggagcagctg gccagagcca tccccctggg ccacagctgc cagtggaccg
841 cagcactcta ctcccgagac atgcgctttg tgcactacca gaccctgaga gccctattcc
901 agtacaaacc ccagaacgtg gatgagctga cgctaagtcc tggtgactac atctttgtgg
961 accccacgca gcaggacgaa gccagcgagg gctgggtgat tgggatctca cagcggacgg
1021 gctgccgggg cttcctgccg gaaaactaca cggatcgagc cagtgagtct gacacgtggg
1081 tgaagcacag gatgtacacc ttcagtctag ccacagacct gaactccaga aaggatggtg
1141 aagccagcag cagatgcagc ggggaatttc ttccacaaac ggcaaggagt cttagcagct
1201 tacaggcctt gcaggctacc gttgcaagga agagcgtgct ggtggttcgc cacgggggaga
1261 gagtggatca gatcttcggg aaggcatggc tgcagcaatg ctccactcct gatgggaaat
1321 actacaggcc agacctgaat ttcccctgca gtctgccaag acggagtcgt gggatcaaag
1381 actttgaaaa cgatccccca ttatcatcgt gtggcatttt ccagtccaga attgcagggg
1441 acgcgctact ggacagtggt atcagaatca gctctgtgtt tgcctcccca gccctccgct
1501 gtgtgcagac ggccaaactc atcctggaag aactcaaact ggagaaaaaa atcaagatac
1561 gagtggaacc tggaatcttt gaatggacaa aatgggaagc tggcaaaacc accccaaccc
1621 tcatgagcct ggaagagctg aaagaggcaa atttcaacat tgacactgat tacaggcccg
1681 cgtttcccct gtccgccctc atgccggccg agagctacca ggagtacatg gacaggtgca
1741 cggcgagcat ggtgcaaatc gtcaacacct gtccacagga cacgggtgtc atcctaattg
1801 tgagtcacgg ctccactctg gactcctgca cgcggccact gctcgggctg ccgcccccggg
1861 aatgtgggga ttttgcccaa ctcgtgagaa agatcccttc cctgggcatg tgcttctgtg
1921 aagaaaataa agaggaagga aaatgggagt tggtgaaccc accggtgaag accctgaccc
1981 acggggcgaa cgcagcattt aactggagga actggatctc aggcaactga gagccacggt
2041 gatgttgtca taacctcaga gtggagaggc agaaaccatg tgcagaggct gggagatgct
2101 gctgtttcca gaggcgtctt agtctcaccc aatgtgattt gtagaagcac gagacgcact
2161 tttatatccc ggaatatttc cctccggctt tcgcctttgt aactcccatc tgtggaccca
2221 tcgtccacca gcccagctgc ggggagcaca gggcaggtgg ctgggtgagg atgccgccct
2281 gcagcatgta caccgagtgt ctgcagctgg ggacacaact gcccgggact ctaacttcca
2341 ggaattaaag actcaccaca cacgaaggat ctaaccactt cattttccat ggtctaatca
2401 ttaaattccc aatcgttttt tctttttctg ggtccatcac tctttagcca tatccacatg
2461 ggctaaaaca ggtgtaatag tcaataaaat ggtcccagaa aaccatcgac caggtcaaaa Fig. 17 – SEQ ID NO: 3253

CHODL-Hs01070471_m1 NM_024944.3 2545BP

1 gctgctgctg tgatccagga ccagggcgca ccggctcagc ctctcacttg tcagaggccg
61 gggaagagaa gcaaagcgca acggtgtggt ccaagccggg gcttctgctt cgcctctagg
121 acatacacgg gaccccctaa cttcagtccc ccaaacgcgc accctcgaag tcttgaactc
181 cagccccgca catccacgcg cggcacaggc gcggcaggcg gcaggtcccg gccgaaggcg
241 atgcgcgcag gggtcgggc agctgggctc gggcggcggg agtagggccc ggcagggagg
301 cagggaggct gcagagtcag agtcgcgggc tgcgccctgg gcagaggccg ccctcgctcc
361 acgcaacacc tgctgctgcc accgcgccgc gatgagccgc gtggtctcgc tgctgctggg
421 cgccgcgctg ctctgcggcc acggagcctt ctgccgccgc gtggtcagcg gccaaaaggt
481 gtgttttgct gacttcaagc atccctgcta caaaatggcc tacttccatg aactgtccag
541 ccgagtgagc tttcaggagg cacgcctggc ttgtgagagt gagggaggag tcctcctcag
601 ccttgagaat gaagcagaac agaagttaat agagagcatg ttgcaaaacc tgacaaaacc
661 cgggacaggg atttctgatg gtgatttctg gatagggctt tggaggaatg gagatgggca
721 aacatctggt gcctgcccag atctctacca gtggtctgat ggaagcaatt cccagtaccg
781 aaactggtac acagatgaac cttcctgcgg aagtgaaaag tgtgttgtga tgtatcacca
841 accaactgcc aatcctggcc ttgggggtcc ctacctttac cagtggaatg atgacaggtg
901 taacatgaag cacaattata tttgcaagta tgaaccagag attaatccaa cagcccctgt
961 agaaaagcct tatcttacaa atcaaccagg agacacccat cagaatgtgg ttgttactga
1021 agcaggtata attcccaatc taatttatgt tgttatacca acaatacccc tgctcttact
1081 gatactggtt gcttttggaa cctgttgttt ccagatgctg cataaaagta aaggaagaac
1141 aaaaactagt ccaaaccagt ctacactgtg gatttcaaag agtaccagaa aagaaagtgg
1201 catggaagta taataactca ttgacttggt tccagaattt tgtaattctg gatctgtata
1261 aggaatggca tcagaacaat agcttggaat ggcttgaaat cacaaaggat ctgcaagatg
1321 aactgtaagc tcccccttga ggcaaatatt aaagtaattt ttatatgtct attatttcat
1381 ttaaagaata tgctgtgcta ataatggagt gagacatgct tattttgcta aaggatgcac
1441 ccaaacttca aacttcaagc aaatgaaatg gacaatgcag ataaagttgt tatcaacacg
1501 tcgggagtat gtgtgttaga agcaattcct tttatttctt tcacctttca taagttgtta
1561 tctagtcaat gtaatgtata ttgtattgaa atttacagtg tgcaaaagta ttttaccttt
1621 gcataagtgt ttgataaaaa tgaactgttc taatatttat ttttatggca tctcattttt
1681 caatacatgc tcttttgatt aaagaaactt attactgttg tcaactgaat tcacacacac
1741 acaaatatag taccatagaa aaagtttgtt ttctcgaaat aattcatctt tcagcttctc
1801 tgcttttggt caatgtctag gaaatctctt cagaaataag aagctatttc attaagtgtg
1861 atataaacct cctcaaacat tttacttaga ggcaaggatt gtctaatttc aattgtgcaa
1921 gacatgtgcc ttataattat ttttagctta aaattaaaca gattttgtaa taatgtaact
1981 ttgttaatag gtgcataaac actaatgcag tcaatttgaa caaaagaagt gacatacaca
2041 atataaatca tatgtcttca cacgttgcct atataatgag aagcagctct ctgagggttc
2101 tgaaatcaat gtggtccctc tcttgcccac taaacaaaga tggttgttcg gggtttggga
2161 ttgacactgg aggcagatag ttgcaaagtt agtctaaggt ttccctagct gtatttagcc
2221 tctgactata ttagtataca aagaggtcat gtggttgaga ccaggtgaat agtcactatc
2281 agtgtggaga caagcacagc acacagacat tttaggaagg aaaggaacta cgaaatcgtg
2341 tgaaaatggg ttggaaccca tcagtgatcg catattcatt gatgagggtt tgcttgagat
2401 agaaaatggt ggctcctttc tgtcttatct cctagtttct tcaatgctta cgccttgttc
2461 ttctcaagag aaagttgtaa ctctctggtc ttcatatgtc cctgtgctcc ttttaaccaa
2521 ataaagagtt cttgtttctg aagaa Fig. 18-1 – SEQ ID NO: 3254

PKNOX1-Hs01007092_m1 NM_004571 5300BP

1 gtgtcgcgtg gcccagcgtc ggcgtgacgg ttggacgcgg gcgcggcact gcgggtcccg
61 attgctgcag ccgcttgtca gtgtgatgaa gattggcacc cagacaccat tcgcttttca
121 cccaagatga tttgatgtct tataaaactc tgatgaacca tgatggctac acagacatta
181 agtatagaca gctatcaaga tgggcaacag atgcaagtag taacagagtt aaagacagaa
241 caagatccaa actgctctga acccgatgca gaaggagtga gccctccccc tgtggagtct
301 cagaccccga tggatgtgga caagcaggcc atttataggc atccactatt tccattatta
361 gctttgttgt ttgaaaaatg tgaacaatct acacagggct ctgaaggcac aacttctgcc
421 agttttgatg tagacatcga aaattttgta agaaagcaag agaaggaagg gaaacctttc
481 ttttgtgaag atccagaaac tgataattta atggtaaaag caatccaggt tttgcgcatt
541 catcttcttg agctggaaaa ggttaacgaa ctctgcaaag atttctgcag tcgatacatt
601 gcttgtctga aaacaaaaat gaacagtgaa actctgttga gtggagagcc tggaagcccg
661 tactcaccag tgcagtccca gcagattcaa agtgccatca caggcaccat cagccctcag
721 ggaattgtgg tgccggcgtc cgcgctgcag cagggaaacg tagccatggc gacggtggca
781 ggtggcacag tgtatcagcc tgtcacggtc gtcactcccc aaggccaagt ggtcacacag
841 acattgtcgc ctgggacaat taggatccag aactcccagc ttcagttaca gttaaaccaa
901 gatctcagca tcttgcatca agatgatggt tcatctaaga acaagagggg cgtcctgcca
961 aagcatgcca cgaacgtgat gcggtcctgg ctcttccagc acatcgggca tccctaccca
1021 acagaggatg agaaaaaaca gattgctgct cagacaaatt tgacactact ccaagtcaac
1081 aactggttca tcaatgccag aagacgaatt cttcagccaa tgttggattc aagttgttca
1141 gagaccccca aaacaaagaa aaaaactgct cagaaccggc cagttcagag gttttggcct
1201 gattctattg catcaggagt cgcacagcca ccgccgagcg agctcaccat gtcggaagga
1261 gctgttgtca ccatcaccac gcccgtgaac atgaacgtgg acagccttca gtctctgtcc
1321 tcggacgggg ccaccctggc ggtgcagcag gtcatgatgg cagggcagag cgaggacgag
1381 tctgtggaca gcacagagga ggatgcgggt gccctggccc ctgcccacat cagcgggctg
1441 gtcttggaga acagtgactc cctgcagtag gggcaggagc agacgcacct gactttttgg
1501 agtttgcaca gcaaacattt tacacagttt tatttctaat atgttttata tgtagatata
1561 gaagagtgca cttttgtatt tcatagtaag cttaaagcgc gtctttgccg gtgcagcgac
1621 ttctttcaag tgtgtgtgtg tgtgtgtgtg tgtgtgtgtg tgcgtgtgtg cgtgtgtgtg
1681 gatttttaaa gaaattcttt aaaggtttaa cgctagattg tgaggaatga cacaccactc
1741 cctccccacc ttgaatccct aattagatta aggaatagcg ctgccatttt ctaaaccgtg
1801 atgcggttgt cacttagttc tgtggttcca gcagatctca gtgggctggt tgatttgtgt
1861 ggcccatgga tttgaaagaa gctgctgcac ccgaaactgc cagtgtgcgg tgacaacggc
1921 acacgcctag actgagtgtg gtttcgtcgt gagtggatgg acggcaagct tagcaagcct
1981 aagtcccctc atgttcagtg agcctgtttc atttgctata tagaaaaaga aactcctatt
2041 tttaccttgc tggaattatt ggataaaaaa gctattttta taaattcgtt atgaattgga
2101 tgatgactat attgaggata aaatttctag agaagaaaca atacatgctt gctattaata
2161 tttcaatttg gaatgttctg aattgaccaa atttaatgaa cctgcccaaa gttagctacc
2221 gttccatggt tctttgctct ccccgggtag tgatgaacat ttactactat aaaagaaaca
2281 gctatttaat gaaattttga tatctgcaaa tttttgttga tatgtaatgc tcagattgca
2341 ttttacactt gatctaaaca tatatcgaaa gatatctgct aaacaggact tcaggtaagt
2401 gaggtgaaat ggtagccagt gacccgttag gagctctcac cgtacatact ccagtctaat
2461 ttaaatctga ccacagttgc atggtcgctt taccatgtta gctgtgtatt gttttaaaag Fig. 18-2 – SEQ ID NO: 3254

2521 ttttaacttc aaaatatgtt atgcacagaa tgtttattat aaactaatat aaaatgtgct
2581 ctaccccatt ggctcagagc tagggcaaac agcagatatt cagactttat tacttaacta
2641 gcggacatcc ctggagtccc agcagcgagc tggtctggcg agggcacctc ggcagccccc
2701 acgggttggc tcctacgttt gcgtttgtgg ctggtctcct ggtgtcagtg ttctcttgta
2761 cgttgttgct ttcgactttt cagagccctc ctgctcactt gaccacgtga gatttggaat
2821 aactgtagga cttctgtttc ctggtaacaa gatgaaccga gagagtgggc tgggttctgt
2881 tttctttggt tttgatttgt tttcattgtt tacttaggag tggtgctttt tctcagaaaa
2941 caggccacgg tgtttcatac agaatgtctt catatcatct gaaatggtat ggctgaagtt
3001 catttgttta cagggtcggg aatgtcttca gttcttgaga gtcaacagta atgattggtt
3061 gtaagccaag ggacatttta agctagtgaa gagtttttc tggaattgat ttttcccaaa
3121 agaatatatt aattgaggtt aagaagtcag tgggaaacac acagaaattt gttttaaaat
3181 ctttcaggag ctttactgaa agacttggtt atcaagtctt ttggggagag aatgacattt
3241 ttttttgag acagagtttt gctcttgttg cccaggctgg agggcaatgg tgcaatctca
3301 gctcactgca acctccacct cttatgttca agcaattctc cttccttagc ctcctgagta
3361 gctgggatta caggcatgcg ccaccacacc cggctaattt tgtattttta gtagagatgg
3421 gtttctccat gttggtcggg ctggtctcga actcccgacc tcaggtgatc tgcctgcctc
3481 agcctcccaa agtgctggga ttacaggtgt gagccaccgc gcccggccga gaatgacatc
3541 ttaaagccac cattgcgttc ctcatttgtg aactgtcttc tcatatttta agtcaagtct
3601 ataagatcat ttttaaccta agttccaact ttgttggact ccttaaaata agcacccatg
3661 aaagccagcc agcccttcct ccttccctca ccaccctccg tctcttcggc tgcttgctct
3721 ttagtgtaga ttagtggaag ccattcacag aatgtagact catgtatagg tcaccgtttc
3781 tttccccac tagaaatcac attcactaag cagtggattg aatttaagag tgctgcccct
3841 gcccggcgca gtagggcgtg cctctagttc cagctactcg ggagtctgag gcagaggatg
3901 gcatgtgcca ggagtttgag gctgcagtgc actatgcttg cacctgtgaa tagccactgc
3961 actccatctt gggcaacaca gtgagacccc catctataaa aagagagcac tgcctgaacc
4021 tcggtggcac tgggaagctc tggcctgaga gttaaacacc catgctgaat gatacagtgt
4081 gcattctctc cagctgcaaa ctttcttcaa ctttcctaaa ttcttactaa attcagagga
4141 ataggataaa gatcacttag agaaagggtg cttatggaca tagcctgagt ttcctttaac
4201 ctctctgcaa tgggtgcttt taactagctt ctacatggca agctgtttca gtttgcaaaa
4261 tcactgccca gcatgtttga ggtcagttgg caccttaaaa cacctgttct ccagcccttg
4321 gacagtggag agaatctgta aaagtgtgac cccctctaag atttcgtttt aaatgatcag
4381 attcggttcc agttttattc ttgttgagtt tttccctatg aaggctcctt ttgaatgtgt
4441 cttgagaccc aaattgagca tgttgctgtt attcctgccc tgcacctgtg gagcaggagt
4501 ggcagggctg gctgtgctgg gttccagctc gctcccaccg agggactagc ttggcctttg
4561 cgctttgatt ccagatagta agatgagtgg aagtgtttat cgagcatgca aaagaaaccc
4621 tcacggctaa gggctctggg agttgtgtct gtgtgacctg agagtgatcc atctcctgcc
4681 tgtgtgaggt agcagtgggc acttttcatt gagacaaact ccagggtgtc cagagggggt
4741 tctgcccctt gtgaaggccc attcctggca cttagagaca gaaagaactc agcaatcttt
4801 cgttctagtt atattcggtc tttgaaactg acaatctttg aaatgtgaat actgtaacaa
4861 tatgttttct tggattgttg tctttaaaaa ggatttttgt gaagcaattg atttatcaaa
4921 gcaaaaaaat taaaaataga aacttgcttt atggatgttt tattttataa agctcatgtc
4981 accaaaagct gcttctccat tttatgtaaa acattgagaa tgttttcatg ttttctggtg
5041 acatgtaggg tctgtagtca cccctgcata ttgagaaact aggaccacac tgcatcggac
5101 tagtcaggtc catttacatg tccaagaatc ttttcttaaa ttccttactt tgttcattca
5161 ttggctgttc aggcagaaaa tggaaacagg tagcttttat gtttttttatt atagttttcc
5221 acaaatctaa ttatttgat agttacaaga agataatgat tcatcagtaa gctaacataa
5281 tccctttcat agttcatatt Fig. 19-1 – SEQ ID NO: 3255

CYYR1-Hs00951849_m1 NR_135472 3266BP 1 gcagtcgttg ccacccgcgg agatgaaatg tgagcctggg tggccaagga cgccggagtg
61 gccgccttcc ccgcgcctga gcgcagtggg gcgagacaaa gagacctggg cccccagcgc
121 agcccgtctc gggccacggg cgccccagct ccgcggagtc ccgcagtcgc tggcccggga
181 cgcgcccggc ccgggctccc ttggaaggct ccctaggcaa tggccgggtc tctgctccac
241 ccggctctca ggagcgctgc tctctccatc tgatcgccct ccatcctccc cattccctcc
301 ggttccgggc tctcccttcg ctccaagcct caggccaccg gcttggatgg acgctccgag
361 gctacccgtg cgtccagggg tcttgcttcc gaagttggtc ctgctctttg tctacgcaga
421 tgattgcctt gctcagtgtg gcaaagattg caaatcttac tgctgtgatg gaaccacgcc
481 ctactgttgc tcctactacg cttatattgg gaatatcctc tcatgctgct gtcccaggta
541 gaggtgcgag tataacttgg agaatgtgaa gtcaaactga ttctgtgatt ctttggtcat
601 ctggctccta gcttagctct tgattcacta actatatcat ggagtgtgct gtgtgccctc
661 tttctcactc catagctacc tccaccctgg ggcactgcaa ttgcgggcat tgtttttgga
721 atagtattta tcatgggggt cattgctggg attgccatat gcatctgcat gtgcatgaag
781 aaccacaggg cgacccgcgt gggcatcctc aggacgactc acatcaacac cgtctcctcc
841 tatcctgcag gaccaccacc ctacggtcac gaccacgaga tggaatactg tgcagacttg
901 cctcctccat actcccccac cccacagggt ccagcacagc gttctccacc ccctccttat
961 cctggaaacg caaggaaata atctatctcc cagaacagaa catgtgccaa tgggcgatct
1021 tgcctggaat aaaatgcctc tactcagaaa caggcaggaa agaattgctc caaggaatac
1081 tttttggggt cagataatgt gtcaggtgga atatccctgc taggagatat aggatttcta
1141 ctctgctcaa agctgacccc atctggagta ttaatgtttg gttctatgga accacatttt
1201 aagagatctg ctgatccacc taagcacatt cagggaagag taatgtaatt gacaaaatat
1261 ctgataatca tgttgtttaa gggctaggtg aagaaagttt cagtattgat cctggaaaaa
1321 aagaagatct aagtaggatg ggagaatgat ttggcccaca caaggaagca actttattct
1381 atatagcttt aaaagtcaga actagaattg ttcattcttt cattcatcaa taaatgtatt
1441 ttgagtgcct aagagtttac tatgtgccta gcactgtttg aggtcctgat ggaagttaca
1501 ggacgggtac tctggtttta gtacaagaaa gagcaatgac tagattgctt tgtgaagctc
1561 ttggtagaga cacgctccag aagggataac aaaatcaaat agtagatggg ttcattgggc
1621 ctcagaagtt ctgctcgtat tttaggtggg tgtgaagtga atttctatat gtccaggagt
1681 gaatacaaca gaaagagttg gatcttattt atttaattag ggagttaaaa caagaccaaa
1741 aagactcaac agccgcttga agccaagaac tcttcaatgc cagctactgc cacctaaaaa
1801 tcatctggct ttatagtgga tcagaataaa ggttattcta actgtgggga gaaaaaaaaa
1861 attgtatcaa gttccacagg tagcagacac ttcacttcca agtaaaagat gagaaatcaa
1921 ttattcccac aggattttag gtcagggagc aaaaatctca gaacttgacc atgaagatac
1981 acaacagact cgcaaaaata aagtgggaaa tgaagttcag attccccttct gtagatttcc
2041 ttaaaactat tattttttttc ttcttcgtaa aattttgata atctgttctc ttaaaaaagt
2101 taatgacaca attaagatac tgacatcaaa ttgttgcctt ttaccaaaat gcaaatttta
2161 tgaagtgcct acctttatat gtataaagca tttaataaat aattctaatg tgccatattt
2221 tgctgtgagt gaccttaaca tttatatttt tatatgaatt gtttcatgta tttataaaaa
2281 ttgtatattg aacattggaa atagatgatt agatttttgt gtcattttac aattaaatct
2341 aaaatgctta atccaatatc atcatcaaaa ttcagtgaaa tcccaaaaca gtgccaagaa
2401 ttttgctgaa tgaaacaatc aaacaaagca ttttaaggtg taagttatag tacctgtact
2461 tgcagataag aagcttacta tatcattatt ataagtagca tatattactt tcaaatacct
2521 atattagaaa gatattgatc tgactgaaat ataacctacc tgccagtaag gtccaaaggc Fig. 19-2 – SEQ ID NO: 3255

2581 tgaatttgtt ttgaatgagt tccttgatct ttaagcactg atgattttct tatatatgag
2641 gatgcaaagc attcaagagt ttcagcctgt tctggtgagg ggctccctga cttacataaa
2701 gttttcagtg caattttaat agtacatatg ctttaattta tttttcttct gcgtgtggtc
2761 agacccaatt acactgtggc taagactctc aaagtgccag ggtttctgtg atgattctga
2821 gaatgctgaa tacaaatata ccttatattc tttaaggaaa acggaaagga aagatcagca
2881 gaaatagggt tttctcatct tcaccatcaa taaacattta ttgcgtacct cctatattct
2941 gcaaattttc cccaaataga agccagttca gtccacacca tctcttcttt gagttgttta
3001 tggcctccct taaggcattt tacaaaccca taagcctaca atagatgagt atttttacta
3061 tttgtattaa gtgtcataat agcatcaatg tgcacattac cagtatagac tgttggagtt
3121 cactgattgt tttcatagat gatgcttctt ggggaaaaat agtataggat gtgaaagttt
3181 tgaattacgg ttatttaaaa actaacattt gctatggcca aagtgtttac aataagcaat
3241 aaagtgaaag aacctattat aacaca Fig. 20-1 – SEQ ID NO: 3256 - GART

GART-Hs00531926_m1 NM_000819 3318BP

1 gggccgactt ccggcgagcg ggcaagcggg aaccaggtgg ccacccggtg tcggtttcat
61 tttcctttgg aatttctgct ttacagacag aacaatggca gcccgagtac ttataattgg
121 cagtggagga agggaacata cgctggcctg gaaacttgca cagtctcatc atgtcaaaca
181 agtgttggtt gccccaggaa acgcaggcac tgcctgctct gaaaagattt caaataccgc
241 catctcaatc agtgaccaca ctgcccttgc tcaattctgc aaagagaaga aaattgaatt
301 tgtagttgtt ggaccagaag cacctctggc tgctgggatt gttgggaacc tgaggtctgc
361 aggagtgcaa tgctttggcc caacagcaga agcggctcag ttagagtcca gcaaaaggtt
421 tgccaaagag tttatggaca gacatggaat cccaaccgca caatggaagg ctttcaccaa
481 acctgaagaa gcctgcagct tcattttgag tgcagacttc cctgctttgg ttgtgaaggc
541 cagtggtctt gcagctggaa aaggggtgat tgttgcaaag agcaaagaag aggcctgcaa
601 agctgtacaa gagatcatgc aggagaaagc ctttggggca gctggagaaa caattgtcat
661 tgaagaactt cttgacggag aagaggtgtc gtgtctgtgt ttcactgatg gcaagactgt
721 ggcccccatg cccccagcac aggaccataa gcgattactg gagggagatg gtggccctaa
781 cacaggggga atgggagcct attgtccagc cctcaggtt tctaatgatc tattactaaa
841 aattaaagat actgttcttc agaggacagt ggatggcatg cagcaagagg gtactccata
901 tacaggtatt ctctatgctg gaataatgct gaccaagaat ggcccaaaag ttctagagtt
961 taattgccgt tttggtgatc cagagtgcca agtaatcctc ccacttctta aaagtgatct
1021 ttatgaagtg attcagtcca ccttagatgg actgctctgc acatctctgc ctgtttggct
1081 agaaaaccac accgccctaa ctgttgtcat ggcaagtaaa ggttatcctg gagactacac
1141 caagggtgta gagataacag ggtttcctga ggctcaagct ctaggactgg aggtgttcca
1201 tgcaggcact gccctcaaaa atggcaaagt agtaactcat gggggtagag ttcttgcagt
1261 cacagccatc cgggaaaatc tcatatcagc ccttgaggaa gccaagaaag gactagctgc
1321 tataaagttt gagggagcaa tttataggaa agacgtcggc tttcgtgcca tagctttcct
1381 ccagcagccc aggagtttga cttacaagga atctggagta gatatcgcag ctggaaatat
1441 gctggtcaag aaaattcagc ctttagcaaa agccacttcc agatcaggct gtaaagttga
1501 tcttggaggt tttgctggtc tttttgattt aaaagcagct ggtttcaaag atccccttct
1561 ggcctctgga acagatggcg ttggaactaa actaaagatt gcccagctat gcaataaaca
1621 tgataccatt ggtcaagatt tggtagcaat gtgtgttaat gatattctgg cacaaggagc
1681 agagcccctc ttcttccttg attacttttc ctgtggaaaa cttgacctca gtgtaactga
1741 agctgttgtt gctggaattg ctaaagcttg tggaaaagct ggatgtgctc tccttggagg
1801 tgaaacagca gaaatgcctg acatgtatcc ccctggagag tatgacctag ctgggtttgc
1861 cgttggtgcc atggagcgag atcagaaact ccctcacctg gaaagaatca ctgagggtga
1921 tgttgttgtt ggaatagctt catctggtct tcatagcaat ggatttagcc ttgtgaggaa
1981 aatcgtggca aaatcttccc tccagtactc ctctccagca cctgatggtt gtggtgacca
2041 gactttaggg gacttacttc tcacgcctac cagaatctac agccattcac tgttacctgt
2101 cctacgttca ggacatgtca aagcctttgc ccatattact ggtggaggat tactagagaa
2161 catccccaga gtcctccctg agaaacttgg ggtagattta gatgcccaga cctggaggat
2221 ccccagggtc ttctcatggt tgcagcagga aggacacctc tctgaggaag agatggccag
2281 aacatttaac tgtggggttg gcgctgtcct tgtggtatca aaggagcaga cagagcagat
2341 tctgagggat atccagcagc acaaggaaga agcctgggtg attggcagtg tggttgcacg
2401 agctgaaggt tccccacgtg tgaaagtcaa gaatctgatt gaaagcatgc aaataaatgg
2461 gtcagtgttg aagaatggct ccctgacaaa tcatttctct tttgaaaaaa aaaaggccag
2521 agtggctgtc ttaatatctg gaacaggatc gaacctgcaa gcacttatag acagtactcg Fig. 20–2 - SEQ ID NO: 3256 - GART 2581 ggaaccaaat agctctgcac aaattgatat tgttatctcc aacaaagccg cagtagctgg
2641 gttagataaa gcggaaagag ctggtattcc cactagagta attaatcata aactgtataa
2701 aaatcgtgta gaatttgaca gtgcaattga cctagtcctt gaagagttct ccatagacat
2761 agtctgtctt gcaggattca tgagaattct ttctggcccc tttgtccaaa agtggaatgg
2821 aaaaatgctc aatatccacc catccttgct cccttctttt aagggttcaa atgcccatga
2881 gcaagccctg gaaaccggag tcacagttac tgggtgcact gtacactttg tagctgaaga
2941 tgtggatgct ggacagatta ttttgcaaga agctgttccc gtgaagaggg gtgatactgt
3001 cgcaactctt tctgaaagag taaaattagc agaacataaa atatttcctg cagcccttca
3061 gctggtggcc agtggaactg tacagcttgg agaaaatggc aagatctgtt gggttaaaga
3121 ggaatgaagc cttttaattc agaaatgggg ccagtttaga aagaattatt tgctgtttgc
3181 atggtggttt tttatcatgg acttggccca aaagaaaaac tgctaaaaga caaaaaagac
3241 ctcaccctta cttcatctat ttttttaata aatagagact cactaaaaac aagactagtt
3301 agtgcagcat atctgaga Fig. 21-1 – SEQ ID NO: 3257 RASGRP4

RASGRP4-Hs01073179_m1 NM_170604 3132BP

1 ctctttcctt cccaagcacc gaggaggccc cagctcccta ggggctgaga agctggagtc
61 ctgggcaagg ggaggagctg agccctactc ttgcaagacc cccggcctcc tcaccccacg
121 cgggaagcat gaacagaaaa gacagtaaga ggaagtccca ccaggaatgc accggaaaaa
181 taggagggcg aggccggccc cgccaagtgc gccgccacaa gacatgcccc agccctcggg
241 aaatcagcaa ggtcatggct tccatgaacc tgggcctgct gagtgagggc ggctgcagcg
301 aagatgagct gctggagaaa tgcatccagt ccttcgattc agctggcagc ctgtgccacg
361 aggaccacat gctcaacatg gtgctggcca tgcacagctg ggtgctgccg tccgccgacc
421 tggctgcccg cctgctgacc tcataccaga aggccacagg ggacacccag gagctgagac
481 ggctgcagat ctgtcacctg gtcaggtact ggctgatgcg acaccctgag gtgatgcacc
541 aggatcccca gctagaagaa gtcataggtc gtttctgggc caccgtggcc cgggagggca
601 actcagccca gagaagactg ggagactctt ctgacctcct gagccctggt ggccctggcc
661 ccccactccc aatgagcagc ccaggcctgg gcaaaaagcg caaagtgtcc ttgcttttcg
721 accacttgga gacgggggag ctggctcagc acctcaccta cctggagttc cggtccttcc
781 aggctatcac gccccaggac ctgcggagct acgttttgca gggctcagta cgaggctgcc
841 cggccctgga gggctccgta ggtctcagca acagcgtgtc ccgctgggtg caggtgatgg
901 tgctgagccg tcccgggccc ctacagcgtg cacaggtgct ggacaagttc attcacgtgg
961 cacagaggct ccaccagctg cagaatttca acacgctgat ggcagtcaca gggggcctgt
1021 gtcacagtgc catctccaga ctcaaggact cccatgccca cctgagccct gacagcacca
1081 aggccctcct ggagctcact gagctccttg cctcccacaa caactacgcc cgctaccgcc
1141 gcacctgggc tggctgcgcg ggtttccggc tgcctgtact gggcgtgcac ctcaaggacc
1201 tggtgtccct gcatgaggca cagcccgaca ggttgcctga cggccgcctg cacctaccca
1261 agctgaacaa cctctacctg cggctgcagg agctggtggc cctccaaggg cagcatccac
1321 cctgcagcgc caatgaggat ctgctgcacc tgctcacgct ctccctggac ctcttctaca
1381 cggaagacga gatctatgag ctttcttatg cccgggagcc gcgttgtccc aagagcctgc
1441 caccctcccc cttcaatgca cctctggtgg tggagtgggc ccctggtgtg acacccaagc
1501 cggacagggt cacactgggt cggcatgtgg agcagctggt ggagtctgtg ttcaagaatt
1561 atgaccctga aggccgagga acaatctctc aggaggactt tgagcgactc tcgggcaatt
1621 ttcccttcgc ctgccatggg cttcacccac ccccacgcca ggggagagga tccttcagca
1681 gagaggagct gacagggtac ctgctccggg ccagcgccat ctgctccaag ttgggcctgg
1741 ccttcctgca caccttccat gaggtcacct tccgaaagcc taccttctgc gacagctgca
1801 gtggcttcct ctggggtgtc accaagcaag gctaccgctg tcgggagtgc gggctgtgtt
1861 gccacaaaca ctgcagagac caggtgaagg tagaatgtaa gaagaggcca ggggccaagg
1921 gcgatgcagg acccccccgga gctcctgtcc catccacacc agctccccat gccagctgtg
1981 gctccgagga aaatcactcc tacacgctat ccctggagcc tgagactggg tgccagcttc
2041 gccatgcctg gacccagact gaatccccac acccttcctg ggaaacagat acggtcccct
2101 gcccggtgat ggacccacca tcaactgcat cctccaagct ggattcctag acatctcttg
2161 gtctcctctc ttcctcactc ccttccccca gtcagtcctg agtcctgccg tcagactctg
2221 gcagggctcc cagaggtagg cctccagagg catccgcctt cccatccaca ctgcctttag
2281 tggtacgtcc gtcatctttt tccctggaag tgactttcct cttttgcatc ctggtggatg
2341 ctaatcctgc tccctttccc tgcacttagt atctgtgcgg ctgtgtgttg gatacattta
2401 gactcaggcc tcattctacc aactccctac atctccattt ctttttttttt ttgagacaga Fig. 21-2 – SEQ ID NO: 3257 RASGRP4

2461 gtcttgctct gtcacccagg ctggagtgca atgatgcaat ctcagctcac tgcaacttcc
2521 gcctcctggg ttcaagtgat tcttctgcct cagcctccca agtagctggg attacaggca
2581 cgcgccacca tgcccggcta atttttgtat ttttagtaga gacggggttt ccccatgttg
2641 gccaagatgg tctcaaactc ctgacctcat gatccaccag cctcagcctc ccaaagtgct
2701 gggaatacag gcgtgagcca ccacgcccag ctcctgtttt tctgcataga atgtgctccc
2761 tctgacagcc tatacttttt ccctctttat ctcgttgaac gtctgtcttt cctcaacagg
2821 agcatcaact ccaggagaac agggatttct atcaatgtca ttcactgctg catccccagt
2881 gcctagaaca gggctggcag gtggtaggcg cctgacagat gcttgtctga tgcctgaatg
2941 tctccttacc catgcccacg gcacaggata gatgtgctat agggcaaaga actttgaggg
3001 tcgagcagca ggggcccatt cagtcccagg gagcagagac ccccccaacc ccttcacaaa
3061 ccccaacacc cctgacttgg cccccacaga gagaggtcct acagctgtca taaattaaat
3121 ttattctctg ga Fig. 22-1 – SEQ ID NO: 3258 FAM20A

FAM20A-Hs01034071_m1 NR_027751 3712 BP

1 atgttacaat tacctcccac caggccccac cttcaacact ggggactaca tttcaacatg
61 agatttggag gggacaaaca tccaaaccat atctgatggc gacacaagat gtacagagag
121 cagatgaacc ttacctccct ggacccccca ctgcagctcc gactcgaggc cagctgggtc
181 cagttccacc tgggtattaa ccgccatggg ctctactccc ggtccagccc tgttgtcagc
241 aaacttctgc aagacatgag gcactttccc accatcagtg ctgattacag tcaagatgag
301 aaagccttgc tgggggcatg tgactgcacc cagattgtga aacccagtgg ggtccacctc
361 aagctggtgc tgaggttctc ggatttcggg aaggccatgt tcaaacccat gagcagcgag
421 atgaggagac accagtggac ttcttctact tcattgactt tcagagacac aatgctgaga
481 tcgcagcttt ccatctggac aggattctgg acttccgacg ggtgccgcca acagtgggga
541 ggatagtaaa tgtcaccaag gaaatcctag aggtcaccaa gaatgaaatc ctgcagagtg
601 ttttctttgt ctctccagcg agcaacgtgt gcttcttcgc caagtgtcca tacatgtgca
661 agacggagta tgctgtctgt ggcaacccac acctgctgga gggttccctc tctgccttcc
721 tgccgtccct caacctggcc cccaggctgt ctgtgcccaa cccctggatc cgctcctaca
781 cactggcagg aaaagaggac cccaggactt cttctccccc tcaggtggga ggtcaatccc
841 ctttactgtg acacagtgaa acagatctac ccgtacaaca acagccagcg gctcctcaat
901 gtcatcgaca tggccatctt cgacttcttg atagggaata tggaccggca ccattatgag
961 atgttcacca agttcgggga tgatgggttc cttattcacc ttgacaacgc cagagggttc
1021 ggacgacact cccatgatga aatctccatc ctctcgcctc tctcccagtg ctgcatgata
1081 aaaaagaaaa cacttttgca cctgcagctg ctggcccaag ctgactacag actcagcgat
1141 gtgatgcgag aatcactgct ggaagaccag ctcagccctg tcctcactga accccacctc
1201 cttgccctgg atcgaaggct ccaaaccatc ctaaggacag tggaggggtg catagtggcc
1261 catggacagc agagtgtcat agtcgacggc ccagtggaac agttggcccc agactctggc
1321 caggctaact tgacaagcta agggctggca gagtccagtt tcagaaaata cgcctggagc
1381 cagagcagtc gactcgagtg ccgaccctgc gtcctcactc ccacctgtta ctgctgggag
1441 tcaagtcagc taggaaggaa gcaggacatt ttctcaaaca gcaagtgggg cccatggaac
1501 tgaatcttta ctccttggtg caccgcttct gtcgtgcgtt gccttgctcc gtttttccca
1561 aaaagcactg gcttcatcaa ggccaccgac gatctcctga gtgcactggg aaatctgggt
1621 ataggtcagg cttggcagcc ttgatcccag gagagtacta atggtaacaa gtcaaataaa
1681 aggacatcaa gtggatacct gacttctcag gatccttatt ctagctacaa gtcaaagata
1741 actcctggtc cagacaaaac acctggccta tcacaagctg actaaaaatc tgcactttgg
1801 gccagcgcag gcaacagtaa ctctgacagg ttcaaattag acctcacact ttctactcat
1861 attctagtca ctggacccat ctgaatcagt aatccctact gcccggtcct ggagtaactt
1921 cttagagata ttataacaag tggcaaaaat aaaagaggga tttgctaaga atatcagaaa
1981 aggagtgttc caatttgaag agtattacaa ttgaaataac atcaaatatg tcacactaag
2041 cagccagtaa cagaataaat aattacaacg aaggaaaaaa aaaggaaagt cctccaaggt
2101 caggatggca tgggaacagg cctagcaggg acacaagcct ggagtaaggc aggaaaagag
2161 ccaaggctga ctacagccca ccaaccacaa tcttcttccc taagacccca ggattgtccc
2221 cggcccatcc ccaaaagaag aaaggggcta tgtggaaagg tgaggccctc tagatgcccc
2281 tccctgtgac ggctggctca aaaaagacta agtcaggttt tttattgaag cctcccttag
2341 aagaaagtgt agtagggatt ccttgtctcc tctaccttct ccctgacttg ttgatatctg
2401 aaactccttt taataggagg ctttgtttct tattccataa ttaatgaccg aaaacacaaa
2461 ggacagtaag gtcttcattc catggagtga ctagtcagtc aacaaaagta aaaatgcctc
2521 atttcatcaa atcaactttt ccagtaaagg ccagagttca aatactgtaa gcatgagaat Fig. 22-2 – SEQ ID NO: 3258 FAM20A 2581 agaatggagc tgtcactaaa gagagtacaa ggtcaagaac cagaaatgtc tccaagcttt
2641 ctgcagtgtg agcaaagata gcctcgactg gacaaataac acttctgacc ccgtggtacc
2701 cccacatgac tggtatgctg cccctggact ttgtgtctct ctaaaatcac taccattcac
2761 tgagatctga ccaggtgagg cactcaccaa cgctacagaa gcaacacaca ggtttccaat
2821 cctctcaaac acagatacaa cccccatcct ccaatgtgca tggaagaact ttaaatctca
2881 gagagagtaa gcaaaatcac acaatttagt ggtttagacc tattccaaag tcttcttttc
2941 actgtaacac aaaacccaac agtatcccac ccaatttatg aagtcaaatt tgtttgctta
3001 aaaaaaaaat cagctgggca tgggctcaca cctgtaatcc cagcactttg ggcctaaaca
3061 ggcagatcgc ttggtctcag gagctcgaga ccagcctggg taacatgaca aaaccctgtc
3121 tctacaaaaa aatacaaaaa aaaaaaaatt tttttttaaa tcaactcttt aacagagaaa
3181 ccttaatccc aaagatttcc ttaactgttg tggccctact gcagcatagg gctccccact
3241 tcattcactg tctctcctgc ttcaagatgt ttcttccctg tggatgaaga accaggagat
3301 cacacacaga aatgggaaaa tatctgggta aaaacattca aagaatagca caaaatggtt
3361 tgggacttcc aaataagact ctcaggaaag caggctacag ctctacctca aaacccgcca
3421 cctcctataa cgaaggactg gttttccaat ggcctatata cacattttgc tgcactctac
3481 aaacagaaag caataggctt gaatttcacc atgatatgtg gtacacctac cttattattc
3541 acttatcttt caaccttcca ttactttttg attagtaaca aaattaagac tcatttctca
3601 aaaatatcag aaaaccaacc gtttcattct tactcgagtt cttccagcat gttcattttg
3661 aactgtttac ctcccatgaa ataaaaagtc tcttgactct gaaaaaaaaa aa Fig. 23-1 – SEQ ID NO: 3259 NEK9

NEK9-Hs00929594_m1 NM_033116 8278BP

1 accatcgagc ttcgcggggt tgctgggctg acggatccgc gggccggcat ctgaagcgag
61 cgggacgcag cgcggccagg gcctccgggc atacgcaggc tggtccccaa ggcccgcggc
121 cgccgccatg tcggtgctgg gcgagtacga gcgacactgc gattccatca actcggactt
181 tgggagcgag tccgggggtt gcggggactc gagtccgggg cctagcgcca gtcaggggcc
241 gcgagccggc ggcggcgcgg cggagcagga ggaactgcac tacatcccca tccgcgtcct
301 gggccgcggc gccttcgggg aagccacgct gtaccgccgc accgaggatg actcactggt
361 tgtgtggaag gaagtcgatt tgacccggct gtctgagaag gaacgtcgtg atgccttgaa
421 tgagattgtt attctggcac tgctgcagca cgacaacatt attgcctact acaatcactt
481 catggacaat accacgctgc tgattgagct ggaatattgt aatggaggga acctgtatga
541 caaaatcctt cgtcagaagg acaagttgtt tgaggaagag atggtggtgt ggtacctatt
601 tcagattgtt tcagcagtga gctgcatcca taaagctgga atccttcata gagatataaa
661 gacattaaat atttttctga ccaaggcaaa cctgataaaa cttggagatt atggcctagc
721 aaagaaactt aattctgagt attccatggc tgagacgctt gtgggaaccc catattacat
781 gtctccagag ctctgtcaag gagtaaagta caatttcaag tctgatatct gggcagttgg
841 ctgcgtcatt tttgaactgc ttaccttaaa gaggacgttt gatgctacaa acccacttaa
901 cctgtgtgtg aagatcgtgc aaggaattcg ggccatggaa gttgactcta gccagtactc
961 tttggaattg atccaaatgg ttcattcgtg ccttgaccag gatcctgagc agagacctac
1021 tgcagatgaa cttctagatc gccctcttct caggaaacgc aggagagaga tggaggaaaa
1081 agtcactctg cttaatgcac ctacaaagag accaaggtca agcactgtga ctgaagcacc
1141 cattgctgta gtaacatcac gaaccagtga agtctatgtt tggggtggtg gaaaatccac
1201 cccccagaaa ctggatgtta tcaagagtgg ctgtagtgcc cggcaggtct gtgcagggaa
1261 tacccacttt gctgtggtca cagtggagaa ggaactgtac acttgggtga acatgcaagg
1321 aggcactaaa ctccatggtc agctgggcca tggagacaaa gcctcctatc gacagccaaa
1381 gcatgtggaa aagttgcaag gcaaagctat ccgtcaggtg tcatgtggtg atgatttcac
1441 tgtctgtgtg actgatgagg gtcagctcta tgccttcgga tcagattatt atggctgcat
1501 gggggtggac aaagttgctg gccctgaagt gctagaaccc atgcagctga acttcttcct
1561 cagcaatcca gtggagcagg tctcctgtgg agataatcat gtggtggttc tgacacgaaa
1621 caaggaagtc tattcttggg gctgtggcga atatggacga ctgggtttgg attcagaaga
1681 ggattattat acaccacaaa aggtggatgt tcccaaggcc ttgattattg ttgcagttca
1741 atgtggctgt gatgggacat ttctgttgac ccagtcaggc aaagtgctgg cctgtggact
1801 caatgaattc aataagctgg gtctgaatca gtgcatgtcg ggaattatca accatgaagc
1861 ataccatgaa gttccctaca caacgtcctt taccttggcc aaacagttgt cctttataa
1921 gatccgtacc attgccccag gcaagactca cacagctgct attgatgagc gaggccggct
1981 gctgaccttt ggctgcaaca agtgtgggca gctgggcgtt gggaactaca agaagcgtct
2041 gggaatcaac ctgttggggg gacccttgg tgggaagcaa gtgatcaggg tctcctgcgg
2101 tgatgagttt accattgctg ccactgatga taatcacatt tttgcctggg gcaatggtgg
2161 taatggccgc ctggcaatga cccccacaga gagaccacat ggctctgata tctgtacctc
2221 atggcctcgg cctattttg gatctctgca tcatgtcccg gacctgtctt gccgtggatg
2281 gcataccatt ctcatcgttg agaaagtatt gaattctaag accatccgtt ccaatagcag
2341 tggcttatcc attggaactg tgtttcagag ctctagcccg ggaggaggcg gcgggggcgg
2401 cggtggtgaa gaagaggaca gtcagcagga atctgaaact cctgacccaa gtggaggctt
2461 ccgaggaaca atggaagcag accgaggaat ggaaggttta atcagtccca cagaggccat
2521 ggggaacagt aatggggcca gcagctcctg tcctggctgg cttcgaaagg agctggaaaa Fig. 23-2 – SEQ ID NO: 3259 NEK9

2581 tgcagaattt atccccatgc ctgacagccc atctcctctc agtgcagcgt tttcagaatc
2641 tgagaaagat accctgccct atgaagagct gcaaggactc aaagtggcct ctgaagctcc
2701 tttggaacac aaaccccaag tagaagcctc gtcacctcgg ctgaatcctg cagtaacctg
2761 tgctgggaag ggaacaccac tgactcctcc tgcgtgtgcg tgcagctctc tgcaggtgga
2821 ggttgagaga ttgcagggtc tggtgttaaa gtgtctggct gaacaacaga agctacagca
2881 agaaaacctc cagattttta cccaactgca gaagttgaac aagaaattag aaggagggca
2941 gcaggtgggg atgcattcca aaggaactca gacagcaaag gaagagatgg aaatggatcc
3001 aaagcctgac ttagattcag attcctggtg cctcctggga acagactcct gtagacccag
3061 cctctagtct cctgagcctg tagagccccc aggagactgg gacccaaaga acttcacagc
3121 acacttaccg aatgcagaga gcagctttcc tggctttgtt cacttgcaga aaaggagcgc
3181 aaggcagagg ctctgaagca ctttccttgt acatttggag agtggcattg ccttttagat
3241 aggatctagg agtgatttta ttgttttgga gaatggaagg gcccccatgg ccctggcttt
3301 gtcatcagtg actgccatag caacagcagc tctgtacctc atctgttgat cccacctttg
3361 aagaggagac acagtgctca ccttaattgc gctggtagca gcttatatcc catgtatcat
3421 tttcaccatt gattggaagc tgccttggga attcagtacc aggcattacc cctctgggtg
3481 ggagagggag aagtgtaaag ttggagtggg ctggaatcag gtgtggcccg cccagtgtcc
3541 tctgcagagt ggtgaagtag tctggccctc ttgggagccc tgagtccagg aaaatatgtc
3601 tgatggagtc aatctagggc ttgtttcgaa aaagttcagt tactctgtgc agctaaatgc
3661 tttaggagga aaggtaggct taggttgctt ttcctctgag ggttgattga aatttcttca
3721 gtgaggaata gagaaagggc aggaccctcc tcatcacaca gctggtgttt caggctgtga
3781 ccaatgcagg gtgggatttc ctaactgtgg atgaggggat gaggtgtctc tgagggatga
3841 ggtgtctcag agaattgagt ccatggggca gtcagaatag ccttaagaga aaatcatgaa
3901 ggagaagagg tcctccttta gctgcctcta cttggtatct tagagagggc ttagagggct
3961 ctcagtcttc tgcccatgaa aagacttctt tgagcctctg ccttcatggc tcttagggtt
4021 ctgatcttga tatcagcagc cccaaccact ttctttctga atgtctagtc agtatttttc
4081 cccttttggt gttttatgaa gccatgtggt aacgaatgaa tctgtatcat ttttcctacc
4141 tgagtggccc aaagccagca ccaaaccctg ggagtccctg aagcctaaca gaacaggtag
4201 aacttgcaaa aggaatttgg ctgagagctc acttctaatc ctgtactcac tgtgtctttg
4261 tagatagaaa caagctagct ttaccaaaga gaaatagtgt catagaagaa caaaacttca
4321 tatagaaagt tctaggcaag tatttgatgg tttccttaag gatgtgagct ttgtatttcc
4381 acctagcctt gtaaaatgtt cctgtggtat tttgtgtcac acatcctacc tttgatgagt
4441 ctcacatccc accttcctat aaacagctaa attaattttg tttcatcttc cccagaccaa
4501 aatgtttgat aatcttatca acattgtggg aggtcttgtg caatggaaat tttgccattt
4561 ctccaaaact ggtggcataa aggctgatgc ttggggagaa ccccattgct cgggacaggc
4621 aactctgttc aatgggatct tctttggttt gatgttccca ttgttttctc agttctggga
4681 agcctagtac attagtacta atgtaatcac tgaaaccttt tcttgaaata agggaagcag
4741 ccaaactttg attaaagttg caagttctgg ggacttgcgg gggttgtcat aaactgtaac
4801 agtgggtttt ggttcagcat gtaaatgcaa ctttgatttt cttgaggacc gattgacctg
4861 tcatgtccct gtatcctcat gctcatcatc tcagcaggcc tgagaggctg ggtcagtttg
4921 ggtgttcatc atgaggattg cttctgccat ggagctgatg gacatgggca ggttgctgag
4981 aaggtggggt gaaagtgagt gccgggggtg ggtgagtgcc ctggtcttgt tcatagggga
5041 gcctttccct agcagtggaa cgctgtggtc attttctcta gcatattccc ttgggaagtc
5101 tagatttgct attaatctgg ctgagaatct aagttctgtg ccttagagac agtttgcact
5161 ttcccatatt gtgcctggga cagccatatg attttttttc ccaccaaaca agtatgcaaa Fig. 23-3 – SEQ ID NO: 3259 NEK9

5221 cagaaaccag ttcaaagggg gatggagtaa aagatgaggc agtagaaatg cctttgaatg
5281 gttttctgta gctaattctc tttaaatttt gtcctgcttt ttttctttat gcagtgctag
5341 gtgttttaag ttttctagta gtattgcttt tgagttacag tataacctga gttactcctc
5401 tgctctaaca ttgttgcaga agaactagtt tattgttagc caggttgctt gaaaggttga
5461 gagtggagtg gtttggcatt tctgttttaa ataaacattt aagctcttaa tcagtactgt
5521 gcttcagtaa gcctgtgcat ggaccttagt ctctggggat aaaacatcca gattctaagc
5581 ctccgtgaat ctttgattct gtgagtcttt atataaataa tgttcttgga acagaaacaa
5641 tgcaagggac atctgcacag aaatattctt tgcttctctc cagtttctta ttcttgccag
5701 cagaatcatt gctgctgcta cagctttttt cccaaaaatg tctaaaagtg ccgaaagtgc
5761 agagggaggg aaaaaatgag ccactaaaag aaggatgatc ctttcttgta cctacctcct
5821 cagtctcagt gggggccttt ccaagtgata atgccagttt atggtttgta aaacttttcc
5881 ttcaaagaga ttgaactgaa tttggtctcc ctggcatagc acagccaagt tacaacttct
5941 cttggctgag catttcactg aagtttaaag caaaagtaca ctaaaaaatt tcatttcact
6001 tgccatatgt tcacaaacat tcataataga acaattcagg ggcaagaata cattttaaat
6061 aaattcattc acatgaaatc cctaaacctc caaaaaagta ttcatgatgg tcagggcaga
6121 gtgggctata atcaggacta taaaacatgt tcctaactgc tgcaaagcca aaaatcattt
6181 attgtttcaa tgattaactg tggaaataaa cacgctgatc attaaacctc acagaatgat
6241 gaacattagg gagaaaaact ccactatgtc acatctctgt taccacctgt gtagctgtgg
6301 agagtgataa attgataatg aaagcaaaca ttggccagaa ggtgctgtgc tgcattacat
6361 acattgctgt taagaaatac tgtctcgggc cagacgcagt ggctcacgcc tgtaatccca
6421 gcactttggg aggccgaggc gggcggatca cgaggtcagg agatcgagac catcctggct
6481 aacacagtga aatcccgtct ctactaaaaa tacaaaaaaa ttagctgggt gttgtggcag
6541 gtgcctgtag tcccagctac tctggaggct gaggcaggag aatggcgtga acccaggagg
6601 cggagtttgc agtgagctga gattgcgcca cggtactcca gcctgggcga cagagtgaga
6661 ctccatctca aaaataaaaa aaaaaatact gtcttggcag gacaggcgcg gtggctcacg
6721 cctgtaatcc cagcactttg ggaggccgag gtgggcaggt caggagttca agaccatcct
6781 ggctaacaca gtgaaacccc atctctacta aaaatacaaa aaatcagccg ggcgtggtgg
6841 tgggcgcctg tagtcccagc tactcgggag gctggggcag aagaatggcg tgaacccggg
6901 aggcggagct tgcagtgggc caagatcact ccactgcact ccagcctggg tgacaagagc
6961 gagactccgt ctcaaaaaaa aaaaaaaaga aatactgtct cggcacatct gcatacattt
7021 ttaatgaaat gagtttccac atgaggagtt tccccgtgaa atttctccta tggtgtaacc
7081 ttatgaactt tataatgttt acttgcacta aacatttctt ggataaagtt gtataaaata
7141 cagacattaa gaagcagcat gcatttactg tcatcgtctg agctatccag gaagaaattc
7201 agattttttt aaaaaaaggt tcttatctct tcccagagac cagatcaaga taaatttaaa
7261 agatgaaaga tatttctttt tttttttct ttttttttt ttgagatgga ttcttactag
7321 gtcaccaggc tggagtgcag tggcgcgatc tcagctcact gcaacctctg cctcctgggt
7381 tcaagcaatt ctcctgcctc agcctcccga gtagttggga ctacaggtgt gcgccaccac
7441 gcccagctaa tttttgtatt tttagtagag acggggtttc accatgttgg ccaggatggt
7501 ctcgatctct tgactttgtg atccgcccac ctcggcctcc caaagtgctg ggattacagg
7561 catgagccac catgctcggc cttgaaagat atttctaata taaccaaggc ctaaacatgt
7621 agagattaaa gggaacactt aaggcattga ctattgtttt atttctttag caaaatgaga
7681 gcaaacaact gcttcctttt tagaaagcac tccccacata taacaacaat ttgttctctc
7741 tggagggccc ggatctatga ccttactaac atccagcgat cccaaatcca agtgcctgtg
7801 gtaccaggca gataaggtaa agaagtgaag caggccaagt gagactgcag tggtctggtg Fig. 23-4 – SEQ ID NO: 3259 NEK9

7861 ctaccattcc catctggagg agcatctgat tctaaacccc acccaatttg tgccatgcgg
7921 gttgctggcc cagtgtttcc agaacttcca gtttttcaag agatgttcca tatcccagtt
7981 tttaaatgtc agatcatatt atgaatgcta ggccagcgaa ataaaacatc tgtggagcaa
8041 agcaatccac atgttgccat tttgtgacct tggccacagc ttactcttgc catctattgc
8101 aatgtactgg tttacattcc cacttaaagt gtacatttca ttgaacttgc ctagggaatg
8161 tacctattag gttaaatatc cattatctct gtgtgaggtt tccttaaggg gctaaccata
8221 aagctttatt atgtgatacc tcctttcctt tggaacaatt aaaaagagtg caaagaaa Fig. 24-1 – SEQ ID NO: 3260 ABCC1

ABCC1-Hs01561504_m1 | NM_004996 6504BP

1 gccgccgccg ccgccgccag cgctagcgcc agcagccggg cccgatcacc cgccgcccgg
61 tgcccgccgc cgcccgcgcc agcaaccggg cccgatcacc cgccgcccgg tgcccgccgc
121 cgcccgcgcc accggcatgg cgctccgggg cttctgcagc gccgatggct ccgacccgct
181 ctgggactgg aatgtcacgt ggaataccag caaccccgac ttcaccaagt gctttcagaa
241 cacggtcctc gtgtgggtgc cttgttttta cctctgggcc tgtttcccct tctacttcct
301 ctatctctcc cgacatgacc gaggctacat tcagatgaca cctctcaaca aaaccaaaac
361 tgccttggga tttttgctgt ggatcgtctg ctgggcagac ctcttctact ctttctggga
421 aagaagtcgg ggcatattcc tggccccagt gtttctggtc agcccaactc tcttgggcat
481 caccatgctg cttgctacct ttttaattca gctggagagg aggaagggag ttcagtcttc
541 agggatcatg ctcactttct ggctggtagc cctagtgtgt gccctagcca tcctgagatc
601 caaaattatg acagccttaa aagaggatgc ccaggtggac ctgtttcgtg acatcacttt
661 ctacgtctac ttttccctct tactcattca gctcgtcttg tcctgtttct cagatcgctc
721 acccctgttc tcggaaacca tccacgaccc taatccctgc ccagagtcca gcgcttcctt
781 cctgtcgagg atcaccttct ggtggatcac agggttgatt gtccggggct accgccagcc
841 cctggagggc agtgacctct ggtccttaaa caaggaggac acgtcggaac aagtcgtgcc
901 tgttttggta aagaactgga agaaggaatg cgccaagact aggaagcagc cggtgaaggt
961 tgtgtactcc tccaaggatc ctgcccagcc gaaagagagt tccaaggtgg atgcgaatga
1021 ggaggtggag gctttgatcg tcaagtcccc acagaaggag tggaacccct ctctgtttaa
1081 ggtgttatac aagacctttg ggccctactt cctcatgagc ttcttcttca aggccatcca
1141 cgacctgatg atgttttccg ggccgcagat cttaaagttg ctcatcaagt tcgtgaatga
1201 cacgaaggcc ccagactggc agggctactt ctacaccgtg ctgctgtttg tcactgcctg
1261 cctgcagacc ctcgtgctgc accagtactt ccacatctgc ttcgtcagtg gcatgaggat
1321 caagaccgct gtcattgggg ctgtctatcg gaaggccctg gtgatcacca attcagccag
1381 aaaatcctcc acggtcgggg agattgtcaa cctcatgtct gtggacgctc agaggttcat
1441 ggacttggcc acgtacatta acatgatctg gtcagccccc ctgcaagtca tccttgctct
1501 ctacctcctg tggctgaatc tgggcccttc cgtcctggct ggagtggcgg tgatggtcct
1561 catggtgccc gtcaatgctg tgatggcgat gaagaccaag acgtatcagg tggcccacat
1621 gaagagcaaa gacaatcgga tcaagctgat gaacgaaatt ctcaatggga tcaaagtgct
1681 aaagctttat gcctgggagc tggcattcaa ggacaaggtg ctggccatca ggcaggagga
1741 gctgaaggtg ctgaagaagt ctgcctacct gtcagccgtg ggcaccttca cctgggtctg
1801 cacgcccttt ctggtggcct tgtgcacatt tgccgtctac gtgaccattg acgagaacaa
1861 catcctggat gcccagacag ccttcgtgtc tttggccttg ttcaacatcc tccggtttcc
1921 cctgaacatt ctccccatgg tcatcagcag catcgtgcag gcgagtgtct ccctcaaacg
1981 cctgaggatc tttctctccc atgaggagct ggaacctgac agcatcgagc gacggcctgt
2041 caaagacggc gggggcacga acagcatcac cgtgaggaat gccacattca cctgggccag
2101 gagcgaccct cccacactga atggcatcac cttctccatc cccgaaggtg ctttggtggc
2161 cgtggtgggc caggtgggct gcggaaagtc gtccctgctc tcagccctct tggctgagat
2221 ggacaaagtg gaggggcacg tggctatcaa gggctccgtg gcctatgtgc cacagcaggc
2281 ctggattcag aatgattctc tccgagaaaa catccttttt ggatgtcagc tggaggaacc
2341 atattacagg tccgtgatac aggcctgtgc cctcctccca gacctggaaa tcctgcccag
2401 tggggatcgg acagagattg gcgagaaggg cgtgaacctg tctgggggcc agaagcagcg
2461 cgtgagcctg gcccgggccg tgtactccaa cgctgacatt tacctcttcg atgatcccct
2521 ctcagcagtg gatgcccatg tgggaaaaca catctttgaa aatgtgattg gccccaaggg Fig. 24-2 – SEQ ID NO: 3260 ABCC1

2581 gatgctgaag aacaagacgc ggatcttggt cacgcacagc atgagctact tgccgcaggt
2641 ggacgtcatc atcgtcatga gtggcggcaa gatctctgag atgggctcct accaggagct
2701 gctggctcga gacggcgcct tcgctgagtt cctgcgtacc tatgccagca cagagcagga
2761 gcaggatgca gaggagaacg gggtcacggg cgtcagcggt ccagggaagg aagcaaagca
2821 aatggagaat ggcatgctgg tgacggacag tgcagggaag caactgcaga gacagctcag
2881 cagctcctcc tcctatagtg gggacatcag caggcaccac aacagcaccg cagaactgca
2941 gaaagctgag gccaagaagg aggagacctg gaagctgatg gaggctgaca aggcgcagac
3001 agggcaggtc aagctttccg tgtactggga ctacatgaag gccatcggac tcttcatctc
3061 cttcctcagc atcttccttt tcatgtgtaa ccatgtgtcc gcgctggctt ccaactattg
3121 gctcagcctc tggactgatg accccatcgt caacgggact caggagcaca cgaaagtccg
3181 gctgagcgtc tatggagccc tgggcatttc acaagggatc gccgtgtttg gctactccat
3241 ggccgtgtcc atcgggggga tcttggcttc ccgctgtctg cacgtggacc tgctgcacag
3301 catcctgcgg tcacccatga gcttctttga gcggaccccc agtgggaacc tggtgaaccg
3361 cttctccaag gagctggaca cagtggactc catgatcccg gaggtcatca agatgttcat
3421 gggctccctg ttcaacgtca ttggtgcctg catcgttatc ctgctggcca cgcccatcgc
3481 cgccatcatc atcccgcccc ttggcctcat ctacttcttc gtccagaggt tctacgtggc
3541 ttcctcccgg cagctgaagc gcctcgagtc ggtcagccgc tccccggtct attcccattt
3601 caacgagacc ttgctggggg tcagcgtcat tcgagccttc gaggagcagg agcgcttcat
3661 ccaccagagt gacctgaagg tggacgagaa ccagaaggcc tattacccca gcatcgtggc
3721 caacaggtgg ctggccgtgc ggctggagtg tgtgggcaac tgcatcgttc tgtttgctgc
3781 cctgtttgcg gtgatctcca ggcacagcct cagtgctggc ttggtgggcc tctcagtgtc
3841 ttactcattg caggtcacca cgtacttgaa ctggctggtt cggatgtcat ctgaaatgga
3901 aaccaacatc gtggccgtgg agaggctcaa ggagtattca gagactgaga aggaggcgcc
3961 ctggcaaatc caggagacag ctccgcccag cagctggccc caggtgggcc gagtggaatt
4021 ccggaactac tgcctgcgct accgagagga cctggacttc gttctcaggc acatcaatgt
4081 cacgatcaat ggggagagaaa aggtcggcat cgtggggcgg acgggagctg ggaagtcgtc
4141 cctgaccctg ggcttatttc ggatcaacga gtctgccgaa ggagagatca tcatcgatgg
4201 catcaacatc gccaagatcg gcctgcacga cctccgcttc aagatcacca tcatcccccca
4261 ggaccctgtt ttgttttcgg gttccctccg aatgaacctg gacccattca gccagtactc
4321 ggatgaagaa gtctggacgt ccctggagct ggcccacctg aaggacttcg tgtcagccct
4381 tcctgacaag ctagaccatg aatgtgcaga aggcggggag aacctcagtg tcgggcagcg
4441 ccagcttgtg tgcctagccc gggccctgct gaggaagacg aagatccttg tgttggatga
4501 ggccacggca gccgtggacc tggaaacgga cgacctcatc cagtccacca tccggacaca
4561 gttcgaggac tgcaccgtcc tcaccatcgc ccaccggctc aacaccatca tggactacac
4621 aagggtgatc gtcttggaca aaggagaaat ccaggagtac ggcgccccat cggacctcct
4681 gcagcagaga ggtcttttct acagcatggc caaagacgcc ggcttggtgt gagccccaga
4741 gctggcatat ctggtcagaa ctgcagggcc tatatgccag cgcccaggga ggagtcagta
4801 cccctggtaa accaagcctc ccacactgaa accaaaacat aaaaaccaaa cccagacaac
4861 caaaacatat tcaaagcagc agccaccgcc atccggtccc ctgcctggaa ctggctgtga
4921 agacccagga gagacagaga tgcgaaccac ccaaaacacg cacaccctgc ccctggtgcc
4981 ctgagacaga cacacagcct cacgcccccca ggaatgcaag tggtttcctg gtgcttccca
5041 cggaggagtt ttggcagcca gacttctgga ggaattggtt gtatagaaga tcctagtgac
5101 caaattcagc ctactgcctc ggatctctcc agccgaagtc tgtggactgc aagtctttga
5161 gatgcttctg gctcccatca cctctaacat ccttgtctgg gtctaccagg aacgcttcat Fig. 24-3 – SEQ ID NO: 3260 ABCC1

5221 ttccttgggg ctgcagtttt gtggttgagg ggcctggaga aaatcatttt ctccccttgg
5281 cagtgtccca gggccctgga tggtcctctt accaacatct ggtcttccag gcactcaaaa
5341 gctgggaacc agcatctcag cgccagctct accagttctc gttttgggcc agaggcagcc
5401 tctgcactcc cacgcctgtc ctcctggaag ggacctggtt ggactaacgg ctaacctgga
5461 cctggaactg tagggccagg ggattgtctc agggccgacg ttccacctgg ggcttccctc
5521 cccacccacc ccgactccag gctttccctt ttttcttttg ttcaacattg taagaacaat
5581 caatgctgtt attactgttc ccaccatgat tgatgtgggg taaatattaa ggagatggcc
5641 tcatgggaat ttgaccttga ctagaaatag agactgagag tgagcaacca gctggaaggt
5701 actatgccag tcctagcaga aaaatgtgtt aggggcctgg cccaaagcag tgttggttgc
5761 ttacagtgtt gattgatttt gttctttttt cttaccacct cttttctttc cctctcatgg
5821 tacctgctca tggttatgaa gctttcaaag taaagaacac gaaatacctc ccaagtatta
5881 ccagtgggta ccaaaaaaat gtccccttga gtcttttcct tgtttttaga tgttaattct
5941 ctcccttggc atccggttag ccccccaggg ggggcagcat tgtggagaac ttgatattta
6001 gttactgatg ctcttccagg acacgaaaag aacccatctt tgaatatcaa tgattttttt
6061 tttttaagta ctgttccggg gagaaaaaca gtctcaaaac ttgaacttct tgggaataga
6121 agtgttgggc tgagaagtaa cattcccagg aaatagtgag aagctcgccc tgtgtttgaa
6181 accgtgttgg tctctgtgtt cctggaagaa aacagggaag cagcatcttt taaagcctgt
6241 tctttaaggt gtctcgttag agcccaaagt ggaatccgga aggcagccag agctgaggct
6301 gccccaagac tcagacttgc taagaattac gccgccgact tcaaacccag agagcatctt
6361 tcttttaggc gaaaacgcat atatttattt tttgtaagtt ataccattct ttcacattag
6421 ataaactaag ttttgggga tccttttgta atgacttaca ctggaaatgc gaacatttgc
6481 agtaaaaaaa tatatatata tcta Fig. 25-1 – SEQ ID NO: 3261 SORBS2

SORBS2-Hs01125202_m1| NM_001145671 4718BP

1 agttgtaaag caaacagtgt aggtattgga agccgttcac acctcctttc cgagtatctg
61 catgccttgc tggcccagag cacaagaccc ccattgtgct cccccggctc agaatccaag
121 gaaagaaagg aagcgaagcc tctgcattga gttctaggac agctgagaca cttggattgg
181 acttaatctt aaacctctgg agttcaagac cttttaaaaa gggctaaata aacaatctct
241 acatgtaaaa ggccactgac tcctacttcc tctgtataga gcaactgttg aactcagctg
301 cctgtagata gcggtgggtg tgctcgcaaa cgtgccgcca tgtctgttac gctaacatct
361 gtgaagagag tgcaaagttc tccaaaccta ttggctgcag ggcgtgattc tcagtcacca
421 gactcagctt ggagatctta caatgatggc aatcaggaga cactgaacgg agatgctaca
481 tattcctctc ttgcagcaaa aggttttaga agcgttcgac caaacctaca agataaaaga
541 tcaccaactc agagccagat aacagtgaat ggaaactcag gaggtgccgt gagtcccatg
601 agttactatc agaggccgtt ttccccctcg gcatattctc tcccagcctc actcaactcc
661 agcattgtca tgcagcacgg cacatccctc gattccacag acacatatcc ccagcatgcg
721 cagtctctgg atggcaccac cagcagctct atccccctgt accgatcctc agaggaagag
781 aagagagtga cagtcatcaa agccccgcat tacccaggga tcgggcccgt ggatgaatcc
841 ggaatcccca cagcaattag aacgacagtc gaccggccca aggactggta caagacgatg
901 tttaagcaaa ttcacatggt gcacaagccg gatgatgaca cagacatgta taatactcct
961 tatacataca atgcaggtct gtacaaccca ccctacagtg ctcagtcaca ccctgctgca
1021 aagacccaaa cctacagacc tctttccaaa agccactccg acaacagccc caatgccttt
1081 aaggatgcgt cctccccagt gcctccccca catgttccac ctccagtccc gccgcttcga
1141 ccaagagatc ggtcttcaac agaaaagcat gactgggatc ctccagacag aaaagtggac
1201 acaagaaaat ttcggtctga gccaaggagt atttttgaat atgaacctgg caagtcatca
1261 attcttcagc atgaaagacc accccctctc ccaacaactc cgacacctgt tccaagggaa
1321 cctggccgga agcctctttc tagctcccga ctcggagaag tcactggtag cccctcccct
1381 ccgcccccgga gtggcgcccc cacaccaagc tcgcgcgccc cggctctgtc tcccacccgg
1441 cctcctaaaa agcctctgga ctatgttcaa gatcattctt ctggtgtttt caatgaggcc
1501 tccttgtatc agtcctctat agacagaagc ctggaaagac ccatgagttc tgcaagcatg
1561 gccagtgact tcaggaagcg gaggaagagc gagcctgcag tgggtccacc acggggcttg
1621 ggagatcaaa gtgcgagcag gactagccca ggccgagtgg acctcccagg atcaagcacc
1681 actcttacaa agtctttcac tagctcttct ccttcttccc catcaagagc aaaagaccgt
1741 gagtccccta gaagttactc atccactttg actgacatgg ggagaagtgc accaagggaa
1801 agaagaggaa ctccagaaaa agagaaattg cctgcaaaag ctgtttatga ttttaaggct
1861 cagacatcta aggagttgtc atttaagaaa ggagatactg tctacatcct caggaaaatt
1921 gatcaaaatt ggtatgaggg agaacaccac gggagagtgg gcatcttccc gatctcatac
1981 gtagagaaac tcacacctcc tgagaaagca cagcctgcaa gaccacctcc gccagcccag
2041 cccggagaaa tcggagaagc tatagccaaa tacaacttca acgcagacac aaatgtggag
2101 ctgtcactga gaaagggaga tagagttatt cttcttaaaa gagttgatca aaactggtat
2161 gaaggtaaaa tcccaggaac caacagacaa ggcatcttcc ctgtttccta tgtggaggtc
2221 gtcaagaaga acacaaaagg tgctgaggac taccctgacc ctccaatacc ccacagctat
2281 tctagtgata ggattcacag cttgagctca aataagccac agcgtcctgt gtttactcat
2341 gaaaatattc aaggtggggg ggaaccgttt caggctctgt ataactatac tcccaggaat
2401 gaagatgagc tggagctcag agaaagtgat gtcattgatg tcatggaaaa gtgtgatgac
2461 ggctggtttg tggggacctc aagaagaacc aaattctttg gtactttccc cggaaactac
2521 gtcaagaggc tgtgaattgc gctccctcct tctgtagagg ccgcctgcca gccatgcacc Fig. 25-2 – SEQ ID NO: 3261 SORBS2

2581 tgcgtcaacg cgcctgaaac accccgcggg cctcccgttg tcatgcctta cggtttccaa
2641 tgcgccgtca ccatctccac ctgccaccaa accaccagca gagtagccgc cgctgctgtg
2701 agcctgggga cgacatggca ggctggtccc cctccgtgaa agtgtggatt cctacttcct
2761 gctctaagct ttgacacgtc aaaatgtggg atcagaaaga aaaaaatcat gatatttaaa
2821 aatggtcaaa tatttgaggc aaaaaaaaaa aaaaaaagtg tctccaggag gctgtccagc
2881 ctcgtggctc catttcaaca tctcccccca ggcgatgttc tcccccaaga cgaccagaaa
2941 attgtttatt ggggaatgct gtggtttgca ttttcatatt cttcgcttgg cagtgtgtat
3001 tcttttcaca agtttgccta gtgtcttggt ttacacaata tgacaactgt aactgtactt
3061 tagctattgt ttgcctgcac atacatgttg taatatgcac agtgattaca acctttaaag
3121 caagaggagg cgagttaatt tggatgagtg tgattttgct gattgaatgt gagttttcaa
3181 ataggagtct ttttctgcaa tttgtttgca ttttttagaa gtgcaaacag taagtaaata
3241 aaagccttcg gtaataatca tgacaataca agaggctgag ctaggctaca ggggaaaact
3301 attgtgttgt aaagttgcat cgctatttta tattaaaatg taatgatcag catcatgaac
3361 aatgagctct tagtgtttta tttatctgaa aaaatgtaag taaaagcagt gttagtgaga
3421 ggtgcaaaga attattctaa cagacacctg aaagtatctg taagcaatac tagtaggtaa
3481 gatttcactg tgtgtacaca tacacatttg agattgtatg agaacatata atccatatga
3541 tatgttgtac attttatgga aatgtaatag aatctcacac attattttat agaaatagag
3601 tacagaagca tcacaagtat taaagttggt tttagcaagg attaggatta ctacaattat
3661 ttttactata ataattattt ttcttctatg gaactcagaa tcctggctac atttgaggac
3721 aggaatatgt tgagcctgat tttcctggtg tgtgtaaaat atttcctagg aataaattag
3781 gcacttttta gaagcaatgt taaatcattc aggttttatt ttctgccctg aagcagaaat
3841 ttaaaaaatg atattgggac ctggaaggtt taatatggtt cacagtgcct gaattacacc
3901 tgctccgaaa actagctttg tatttcttat gactttgcat aagaactgtt catctttgga
3961 tcttgagcac cttacagata aaacttttta tggcatctct ttcatggaca gtgatattga
4021 tcttttcaca atgtacgtag cctctagaat tttgtacata tgtttgctct ttttttgtac
4081 agactagttg ttgagaaaac aggggcgttt cctaatttgg tctttatcct gcgacaacac
4141 tttcagcaga ctagcctctc cttatctcac agatcacaag caccccctaga tagtgtgatt
4201 ctgtcagata gcatttatgc aaaaatctat gaagttaaaa gatcgtagaa gccaaatgaa
4261 atgtacatat ctactgactg atgacaaggg aatttcatta ggaagaaggt aaagaaacat
4321 cgttgagtag cctaccttga tttctgtcaa gttcataacc agcttcatat tttaaaggct
4381 tcaggtttga aattaagtca actgcatgca gctttgctga taaatgaata attctctttg
4441 atgccattta tgagaaaaga cttcaatatc tgttgcctgt catatttaag aaaaattact
4501 gtttctactc tctgtatctg attttaaaag aaaaaactat tcatacctgg cttccaggta
4561 attgactttg aattcttaca agcaaaggtc attgtgtttt tcttgaatag acatctaata
4621 aattttgctt ggaagtatac ttcagttttt cttcttgaca tttatcttta taaaaattgt
4681 gtattttatt ccaacttgtt aaactaagag aaaatgca Fig. 26 – SEQ ID NO: 3262 TMPRSS2-ERG Fusion Gene

TMPRSS2-ERG fusion gene | EF194202 671BP

1 ttcgcttgct gtttctgtga ctttacgctc tgctgaccta gaggtcttag ttccggaggg
61 aggaatgctg ccaccaggag acacaacaat gattcaatta aactagaatt tacgactgcc
121 acctggccac gctgagctcc acatgcctct gaatcaaaag gcaaagagag agttatgcat
181 tggctgggga gacccatctg gactaccaag gagaagctat agactacttc tactccacca
241 ggaaggaagc cttatcagtt gtgagtgagg accagtcgtt gtttgagtgt gcctacggaa
301 cgccacacct ggctaagaca gagatgaccg cgtcctcctc cagcgactat ggacagactt
361 ccaagatgag cccacgcgtc cctcagcagg attggctgtc tcaacccccca gccagggtca
421 ccatcaaaat ggaatgtaac cctagccagg tgaatggctc aaggaactct cctgatgaat
481 gcagtgtggc caaaggcggg aagatggtgg gcagcccaga caccgttggg atgaactacg
541 gcagctacat ggaggagaag cacatgccac ccccaaacat gaccacgaac gagcgcagag
601 ttatcgtgcc agcagatcct acgctatgga gtacagacca tgtgcggcag tggctggagt
661 gggcggtgaa a Fig. 27-1 – SEQ ID NO: 3263 DSCAM

DSCAM-Hs00242097_m1| NM_020693 6855BP

1 agccgagcgc tgggctgagg agcagagaga gcggggcgcc gagtgcgggc ggctgggagc
61 gcgctgagcg ggggagaggc gctgccgcac ggccggccac aggaccacct ccccggagaa
121 tagggcctct ttatggcatg tggctggtaa ctttcctcct gctcctggac tctttacaca
181 aagcccgccc tgaagatgtt ggcaccagcc tctactttgt aaatgactcc ttgcagcagg
241 tgaccttttc cagctccgtg ggggtggtgg tgccctgccc ggccgcgggc tcccccagcg
301 cggccccttcg atggtacctg gccacagggg acgacatcta cgacgtgccg cacatccggc
361 acgtccacgc caacgggacg ctgcagctct acccccttctc cccctccgcc ttcaatagct
421 ttatccacga caatgactac ttctgcaccg cggagaacgc tgccggcaag atccggagcc
481 ccaacatccg cgtcaaagca gttttcaggg aaccctacac cgtccgggtg gaggatcaaa
541 ggtcaatgcg tggcaacgtg gccgtcttca agtgcctcat cccctcttca gtgcaggaat
601 atgttagcgt tgtatcttgg gagaaagaca cagtctccat catcccagaa cacaggtttt
661 ttattaccta ccacggcggg ctgtacatct ctgacgtaca gaaggaggac gccctctcca
721 cctatcgctg catcaccaag cacaagtata gcggggagac ccggcagagc aatggggcac
781 gcctctctgt gacagaccct gctgagtcga tccccaccat cctggatggc ttccactccc
841 aggaagtgtg ggccggccac accgtggagc tgccctgcac cgcctcgggc taccctatcc
901 ccgccatccg ctggctcaag gatggccggc ccctcccggc tgacagccgc tggaccaagc
961 gcatcacagg gctgaccatc agcgacttgc ggaccgagga cagcggcacc tacatttgtg
1021 aggtcaccaa caccttcggt tcggcagagg ccacaggcat cctcatggtc attgatcccc
1081 ttcatgtgac cctgacacca aagaagctga agaccggcat tggcagcacg gtcatcctct
1141 cctgtgccct gacgggctcc ccagagttca ccatccgctg gtatcgcaac acggagctgg
1201 tgctgcctga cgaggccatc tccatccgcg ggctcagcaa cgagacgctg ctcatcacct
1261 cggcccagaa gagccattcc ggggcctacc agtgcttcgc tacccgcaag gcccagaccg
1321 cccaggactt tgccatcatt gcacttgagg atggcacgcc ccgcatcgtc tcgtccttca
1381 gcgagaaggt ggtcaacccc ggggagcagt tctcactgat gtgtgcggcc aagggcgccc
1441 cgccccccac ggtcacctgg gccctcgacg atgagcccat cgtgcgggat ggcagccacc
1501 gcaccaacca gtacaccatg tcggacggca ccaccatcag ccacatgaac gtcacaggcc
1561 cccagatccg cgacgggggc gtgtaccggt gcacagcgcg gaacttggtg ggcagtgctg
1621 aatatcaggc gcgaataaac gtaagaggcc cacccagcat ccgggctatg cggaacatca
1681 cagcagtcgc cgggcgggac acccttatca actgcagggt catcggctat ccctactact
1741 ccatcaagtg gtacaaggat gccctgctgc tgccagacaa ccaccgccag gtggtgtttg
1801 agaatgggac cctcaagctg actgacgtgc agaagggcat ggatgagggg gagtacctgt
1861 gcagtgtcct catccagccc cagctctcca tcagccagag cgttcacgta gccgtcaaag
1921 tgccccctct gatccagccc ttcgaattcc cacccgcctc catcggccag ctgctctaca
1981 ttccctgtgt ggtgtcctcg ggggacatgc ccatccgtat cacctggagg aaggacggac
2041 aggtgatcat ctcaggctcg ggcgtgacca tcgagagcaa ggaattcatg agctccctgc
2101 agatctctag cgtctccctc aagcacaacg gcaactatac atgcatcgcc agcaacgcag
2161 ccgccaccgt gagccgggag cgccagctca tcgtgcgtgt gccccctcga tttgtggtgc
2221 aacccaacaa ccaggatggc atctacggca aagctggtgt gctcaactgc tcggtggacg
2281 gctacccccc acccaaggtc atgtggaagc atgccaaggg gagcgggaac ccccagcagt
2341 accaccctgt gcccctcact ggccgcatcc agatcctgcc caacagctcg ctgctgatcc
2401 gccacgtcct agaagaggac atcggctact acctctgcca ggccagcaac ggcgtaggca
2461 ccgacatcag caagtccatg ttcctcacag tcaagatccc ggccatgatc acttcccacc
2521 ccaacaccac catcgccatc aagggccatg cgaaggagct aaactgcacg gcacggggtg Fig. 27-2 – SEQ ID NO: 3263 DSCAM 2581 agcggcccat catcatccgc tgggagaagg gggacacagt catcgaccct gaccgcgtca
2641 tgcggtatgc catcgccacc aaggacaacg gcgacgaggt cgtctccaca ctgaagctca
2701 agcccgctga ccgtggggac tctgtgttct tcagctgcca tgccatcaac tcgtatgggg
2761 aggaccgggg cttgatccaa ctcactgtgc aagagccccc cgaccccccca gagctggaga
2821 tccgggaggt gaaggcccgg agcatgaacc tgcgctggac ccagcgattc gacgggaaca
2881 gcatcatcac gggcttcgac attgaataca agaacaaatc agattcctgg gacttcaagc
2941 agtccacacg caacatctcc cccaccatca accaggccaa cattgtggac ttgcacccgg
3001 catctgtgta cagcatccgc atgtactctt tcaacaagat tggccgcagt gaaccaagca
3061 aggagctcac catcagcact gaggaggccg ctcccgatgg gcccccccatg gatgttacct
3121 tgcagccagt gacctcacag agcatccagg tgacctggaa ggcacccaag aaggagctgc
3181 agaacggtgt catccggggc taccagattg gctacagaga gaacagcccc ggcagcaacg
3241 ggcagtacag catcgtggag atgaaggcca cgggggacag cgaggtctac accctggaca
3301 acctcaagaa gttcgcccag tatggggtgg tggtccaagc cttcaatcgg gctggcacgg
3361 ggccctcttc cagcgagatc aatgccacca ctctggagga tgtgcccagc cagcccccctg
3421 agaacgtccg ggccctgtcc atcacttctg acgtggccgt catctcctgg tcagagcccc
3481 cgcgcagcac cctcaatggc gtcctcaaag gctatcgggt catcttctgg tccctctatg
3541 ttgatgggga gtggggcgag atgcagaaca tcaccaccac gcgggagcgg gtggagctgc
3601 ggggcatgga gaagttcacc aactacagcg tccaggtgct ggcctacacc caggctgggg
3661 acggcgtacg cagcagtgtg ctctacatcc agaccaagga ggacgttcca ggtcccccctg
3721 ctggcatcaa agctgtccct tcatcagcta gcagtgtggt tgtgtcttgg ctcccccccta
3781 ccaagcccaa cggggtgatc cgcaagtaca ccatcttctg ttccagcccc gggtctggcc
3841 agccggctcc cagcgagtac gagacgagtc cagagcagct cttctaccgg atcgcccacc
3901 taaaccgcgg tcagcagtat ctgctgtggg tggccgccgt cacctctgcc ggccggggca
3961 acagcagcga gaaggtgacc atcgagcctg ctggcaaggc cccagcaaag atcatctcct
4021 ttgggggcac cgtgacaaca ccttggatga aagatgttcg gctgccttgc aattcagtgg
4081 gagatccagc ccctgctgtg aagtggacca aggacagtga agactcggcc attccagtgt
4141 ccatggatgg gcaccggctc atccacacca atggcacact gctgctgcgt gcagtgaagg
4201 ctgaggactc tggctactac acgtgcacgg ccaccaacac tggtggcttt gacaccatca
4261 tcgtcaacct tctggtgcaa gttcccccgg accagccccg cctcactgtc tccaaaacct
4321 cagcttcgtc catcaccctg acctggattc caggtgacaa tgggggcagc tccatccgag
4381 gcttcgtgct acagtactcg gtggacaaca gcgaggagtg gaaggatgtg ttcatcagct
4441 ccagcgagcg ctccttcaag ctggacagcc tcaagtgtgg cacgtggtac aaggtgaagc
4501 tggcagccaa gaacagcgtg ggctctgggc gcatcagcga gatcatcgag gccaagaccc
4561 acgggcggga gccctccttc agcaaagacc aacacctctt cacccacatc aactccacgc
4621 atgctcggct taacctgcag ggctggaaca atgggggctg ccctatcaca gccatcgttc
4681 tggagtaccg gcccaagggg acctgggcct ggcagggcct ccgggccaac agctccgggg
4741 aggtgtttct gacggaactg cgagaggcca cgtggtacga gctgcgcatg agggcttgca
4801 acagtgcggg ctgcggcaat gaaacagccc agttcgccac cctggactac gatggcagca
4861 ccattccacc catcaagtct gctcaaggtg aaggggatga tgtgaagaag ctgttcacca
4921 tcggctgccc tgtcatcctg gccacactgg gggtggcact gctcttcatc gtacgcaaga
4981 agaggaagga gaaacggctg aagcgactcc gagatgcaaa gagtttggca gaaatgttga
5041 taagcaagaa caatagaagc tttgacaccc ctgtgaaagg gccaccccag ggcccacggc
5101 tacacattga catccccagg gtccagctgc tcatcgagga caaagaaggc atcaagcaac
5161 tgggagatga caaggccacc atccctgtga cagatgctga gttcagccaa gctgtcaacc Fig. 27-3 – SEQ ID NO: 3263 DSCAM 5221 cacagagctt ctgtactggc gtctccttgc accacccaac cctcatccag agcacaggac
5281 ccctcatcga catgtctgac atccggccag gaaccaatcc agtgtccagg aagaatgtga
5341 agtcagccca cagcacccgg aaccggtact caagccagtg gaccctgacc aagtgccagg
5401 cctccacacc tgcccgcacc ctcacctccg actggcgcac cgtgggctcc cagcatggtg
5461 tcacggtcac tgagagtgac agctacagtg ccagcctgtc ccaggacaca gacaaaggaa
5521 ggaacagcat ggtgtccact gagagtgcct cttccaccta cgaggagctg gcccgggcct
5581 atgagcatgc caagctggag gagcagctgc agcacgccaa gtttgagatc accgagtgct
5641 tcatctctga cagttcctct gaccagatga ccacaggcac caacgagaac gccgacagca
5701 tgacatccat gagcacaccc tcagagcctg gcatctgccg ctttaccgcc tcaccaccca
5761 agccccagga tgcggaccgg ggcaaaaacg tggctgtgcc catccctcac cgggccaaca
5821 agagtgacta ctgcaacctg cccctgtatg ccaagtcaga ggccttcttt cgaaaggcag
5881 atggacgtga gccctgcccc gtggtcccac cccgtgaggc ctccatccgg aacctggctc
5941 gaacctacca cacccaggct cgccacctga ccctggaccc tgccagcaag tccttgggcc
6001 ttccccaccc aggggccccc gctgccgcct ccacagccac cttacctcag aggactctgg
6061 ccatgccagc ccccccagcc ggcacagccc ccccagcccc cggcccccacc cctgctgagc
6121 cacccaccgc ccccagcgct gcccctccgg cccccagcac cgagcctcca cgagccgggg
6181 gcccacacac caaaatgggg ggctccaggg actcgcttct cgagatgagc acatcggggg
6241 tagggaggtc tcagaagcag ggggccgggg cctactccaa atcctacacc ctggtgtagg
6301 gcccgcagga agagcagcca cgcctggacc gcgccgcgcc gcagccccac acgccagctc
6361 ggctgttttt ctgcattatt tatattcaac tgacagacaa aaaccaacca acgacaaaac
6421 aaaaaccccc aatcatgaac gcctgtacat agaactcttt tgtacaaatg aaactatttt
6481 cttcttctcc atgaagccag ggcacaaaga atttgacagt acaagtcaaa tcccccaccc
6541 cacaaaatat gtgtggagat atatatacat atatagacag acaggaacgc gtccacgagc
6601 tatatatcta tatatttctc tcaccctatt ttgagacaga ggcacaaaga ctcagcaatt
6661 tttttccctc ctcctcacct tccccccagt ctaggtggtt ttgacaaaga ccaaaatccc
6721 aactcagaga cactgcatgc gattttactg ttccaagaaa accaggagtt gcttcaattt
6781 gcagatgctt atgtgttaat accttttttct atgaaaaaag acccagcgcc gtgtgcaata
6841 aaggttatgt ttcta Fig. 28-1 – SEQ ID NO: 3264 ERG

ERG-Hs01573964_m1 NM_004449 5042BP

1 gttttcactt ggtcggaatg gggagagtgt gcaagagatc gctgcgggac aggttcctag
61 agatcgctcc gggacggtcg tgacggcccc cgagggacat gagagaagag gagcggcgct
121 caggttattc caggatcttt ggagacccga ggaaagccgt gttgaccaaa agcaagacaa
181 atgactcaca gagaaaaaag atggcagaac caagggcaac taaagccgtc aggttctgaa
241 cagctggtag atgggctggc ttactgaagg acatgattca gactgtcccg gacccagcag
301 ctcatatcaa ggaagcctta tcagttgtga gtgaggacca gtcgttgttt gagtgtgcct
361 acggaacgcc acacctggct aagacagaga tgaccgcgtc ctcctccagc gactatggac
421 agacttccaa gatgagccca cgcgtccctc agcaggattg gctgtctcaa cccccagcca
481 gggtcaccat caaaatggaa tgtaacccta gccaggtgaa tggctcaagg aactctcctg
541 atgaatgcag tgtggccaaa ggcgggaaga tggtgggcag cccagacacc gttgggatga
601 actacggcag ctacatggag gagaagcaca tgccaccccc aaacatgacc acgaacgagc
661 gcagagttat cgtgccagca gatcctacgc tatggagtac agaccatgtg cggcagtggc
721 tggagtgggc ggtgaaagaa tatggccttc cagacgtcaa catcttgtta ttccagaaca
781 tcgatgggaa ggaactgtgc aagatgacca aggacgactt ccagaggctc acccccagct
841 acaacgccga catccttctc tcacatctcc actacctcag agagactcct cttccacatt
901 tgacttcaga tgatgttgat aaagccttac aaaactctcc acggttaatg catgctagaa
961 acacagattt accatatgag ccccccagga gatcagcctg gaccggtcac ggccacccca
1021 cgccccagtc gaaagctgct caaccatctc cttccacagt gcccaaaact gaagaccagc
1081 gtcctcagtt agatccttat cagattcttg gaccaacaag tagccgcctt gcaaatccag
1141 gcagtggcca gatccagctt tggcagttcc tcctggagct cctgtcggac agctccaact
1201 ccagctgcat cacctgggaa ggcaccaacg gggagttcaa gatgacggat cccgacgagg
1261 tggcccggcg ctggggagag cggaagagca aacccaacat gaactacgat aagctcagcc
1321 gcgccctccg ttactactat gacaagaaca tcatgaccaa ggtccatggg aagcgctacg
1381 cctacaagtt cgacttccac gggatcgccc aggccctcca gccccacccc ccggagtcat
1441 ctctgtacaa gtacccctca gacctcccgt acatgggctc ctatcacgcc cacccacaga
1501 agatgaactt tgtggcgccc caccctccag ccctccccgt gacatcttcc agtttttttg
1561 ctgccccaaa cccatactgg aattcaccaa ctggggggtat ataccccaac actaggctcc
1621 ccaccagcca tatgccttct catctgggca cttactacta aagacctggc ggaggctttt
1681 cccatcagcg tgcattcacc agcccatcgc cacaaactct atcggagaac atgaatcaaa
1741 agtgcctcaa gaggaatgaa aaaagcttta ctggggctgg ggaaggaagc cggggaagag
1801 atccaaagac tcttgggagg gagttactga agtcttacta cagaaatgag gaggatgcta
1861 aaaatgtcac gaatatggac atatcatctg tggactgacc ttgtaaaaga cagtgtatgt
1921 agaagcatga agtcttaagg acaaagtgcc aaagaaagtg gtcttaagaa atgtataaac
1981 tttagagtag agtttggaat cccactaatg caaactggga tgaaactaaa gcaatagaaa
2041 caacacagtt ttgacctaac ataccgttta taatgccatt ttaaggaaaa ctacctgtat
2101 ttaaaaatag aaacatatca aaaacaagag aaaagacacg agagagactg tggcccatca
2161 acagacgttg atatgcaact gcatggcatg tgctgttttg gttgaaatca aatacattcc
2221 gtttgatgga cagctgtcag ctttctcaaa ctgtgaagat gacccaaagt ttccaactcc
2281 tttacagtat taccgggact atgaactaaa aggtgggact gaggatgtgt atagagtgag
2341 cgtgtgattg tagacagagg ggtgaagaag gaggaggaag aggcagagaa ggaggagacc
2401 agggctggga aagaaacttc tcaagcaatg aagactggac tcaggacatt tggggactgt
2461 gtacaatgag ttatggagac tcgagggttc atgcagtcag tgttatacca aacccagtgt
2521 taggagaaag gacacagcgt aatggagaaa ggggaagtag tagaattcag aaacaaaaat Fig. 28-2 – SEQ ID NO: 3264 ERG 2581 gcgcatctct ttctttgttt gtcaaatgaa aattttaact ggaattgtct gatatttaag
2641 agaaacattc aggacctcat cattatgtgg gggctttgtt ctccacaggg tcaggtaaga
2701 gatggccttc ttggctgcca caatcagaaa tcacgcaggc attttgggta ggcggcctcc
2761 agttttcctt tgagtcgcga acgctgtgcg tttgtcagaa tgaagtatac aagtcaatgt
2821 ttttcccccct ttttatataa taattatata acttatgcat ttatacacta cgagttgatc
2881 tcggccagcc aaagacacac gacaaaagag acaatcgata taatgtggcc ttgaatttta
2941 actctgtatg cttaatgttt acaatatgaa gttattagtt cttagaatgc agaatgtatg
3001 taataaaata agcttggcct agcatggcaa atcagattta tacaggagtc tgcatttgca
3061 cttttttag tgactaaagt tgcttaatga aaacatgtgc tgaatgttgt ggattttgtg
3121 ttataattta ctttgtccag gaacttgtgc aagggagagc caaggaaata ggatgtttgg
3181 cacccaaatg gcgtcagcct ctccaggtcc ttcttgcctc ccctcctgtc ttttatttct
3241 agcccctttt ggaacagaag gaccccgggt ttcacattgg agcctccata tttatgcctg
3301 gaatggaaag aggcctatga agctggggtt gtcattgaga aattctagtt cagcacctgg
3361 tcacaaatca cccttaattc ctgctatgat taaaatacat ttgttgaaca gtgaacaagc
3421 taccactcgt aaggcaaact gtattattac tggcaaataa agcgtcatgg atagctgcaa
3481 tttctcactt tacagaaaca agggataacg tctagatttg ctgcggggtt tctctttcag
3541 gagctctcac taggtagaca gctttagtcc tgctacatca gagttacctg ggcactgtgg
3601 cttgggattc actagccctg agcctgatgt tgctggctat cccttgaaga caatgtttat
3661 ttccataatc tagagtcagt ttccctgggc atcttttctt tgaatcacaa atgctgccaa
3721 ccttggtcca ggtgaaggca actcaaaagg tgaaaataca aggtgaccgt gcgaaggcgc
3781 tagccgaaac atcttagctg aataggtttc tgaactggcc cttttcatag ctgtttcagg
3841 gcctgttttt ttcacgttgc agtccttttg ctatgattat gtgaagttgc caaacctctg
3901 tgctgtggat gttttggcag tgggctttga agtcggcagg acacgattac caatgctcct
3961 gacaccccgt gtcatttgga ttagacggag cccaaccatc catcattttg cagcagcctg
4021 ggaaggccca caaagtgccc gtatctcctt agggaaaata aataaataca atcatgaaag
4081 ctggcagtta ggctgaccca aactgtgcta atggaaaaga tcagtcattt ttattttgga
4141 atgcaaagtc aagacacacc tacattcttc atagaaatac acatttactt ggataatcac
4201 tcagttctct cttcaagact gtctcatgag caagatcata aaaacaagac atgattatca
4261 tattcaattt taacagatgt tttccattag atccctcaac cctccacccc cagtccaggt
4321 tattagcaag tcttatgagc aactgggata attttggata acatgataat actgagttcc
4381 ttcaaataca taattcttaa attgtttcaa aatggcatta actctctgtt actgttgtaa
4441 tctaattcca aagccccctc caggtcatat tcataattgc atgaaccttt tctctctgtt
4501 tgtccctgtc tcttggcttg ccctgatgta tactcagact cctgtacaat cttactcctg
4561 ctggcaagag atttgtcttc ttttcttgtc ttcaattggc tttcgggcct tgtatgtggt
4621 aaaatcacca aatcacagtc aagactgtgt ttttgttcct agtttgatgc ccttatgtcc
4681 cggaggggtt cacaaagtgc tttgtcagga ctgctgcagt tagaaggctc actgcttctc
4741 ctaagccttc tgcacagatg tggcacctgc aacccaggag caggagccgg aggagctgcc
4801 ctctgacagc aggtgcagca gagatggcta cagctcagga gctgggaagg tgatggggca
4861 cagggaaagc acagatgttc tgcagcgccc caaagtgacc cattgcctgg agaaagagaa
4921 gaaaatattt tttaaaaagc tagtttattt agcttctcat taattcattc aaataaagtc
4981 gtgaggtgac taattagaga ataaaaatta ctttggacta ctcaaaaata caccaaaaaa
5041 aa Fig. 29-1 – SEQ ID NO: 3265 ICOSLG

ICOSLG-Hs00391287_m1 NM_015259 7078BP

1 gcagttagag ccgatctccc gcgccccgag gttgctcctc tccgaggtct cccgcggccc
61 aagttctccg cgcccccgagg tctccgcgcc ccgaggtctc cgcggcccga ggtctccgcc
121 cgcaccatgc ggctgggcag tcctggactg ctcttcctgc tcttcagcag ccttcgagct
181 gatactcagg agaaggaagt cagagcgatg gtaggcagcg acgtggagct cagctgcgct
241 tgccctgaag gaagccgttt tgatttaaat gatgtttacg tatattggca aaccagtgag
301 tcgaaaaccg tggtgaccta ccacatccca cagaacagct ccttggaaaa cgtggacagc
361 cgctaccgga accgagccct gatgtcaccg gccggcatgc tgcggggcga cttctccctg
421 cgcttgttca acgtcacccc ccaggacgag cagaagtttc actgcctggt gttgagccaa
481 tccctgggat tccaggaggt tttgagcgtt gaggttacac tgcatgtggc agcaaacttc
541 agcgtgcccg tcgtcagcgc cccccacagc ccctcccagg atgagctcac cttcacgtgt
601 acatccataa acggctaccc caggcccaac gtgtactgga tcaataagac ggacaacagc
661 ctgctggacc aggctctgca gaatgacacc gtcttcttga acatgcgggg cttgtatgac
721 gtggtcagcg tgctgaggat cgcacggacc cccagcgtga acattggctg ctgcatagag
781 aacgtgcttc tgcagcagaa cctgactgtc ggcagccaga caggaaatga catcggagag
841 agagacaaga tcacagagaa tccagtcagt accggcgaga aaaacgcggc cacgtggagc
901 atcctggctg tcctgtgcct gcttgtggtc gtggcggtgg ccataggctg ggtgtgcagg
961 gaccgatgcc tccaacacag ctatgcaggt gcctgggctg tgagtccgga gacagagctc
1021 actggccacg tttgaccgga gctcaccgcc cagagcgtgg acagggcttc cgtgagacgc
1081 caccgtgaga ggccaggtgg cagcttgagc atggactccc agactgcagg ggagcacttg
1141 gggcagcccc cagaaggacc actgctggat cccagggaga acctgctggc gttggctgtg
1201 atcctggaat gaggcccttt caaaagcgtc atccacacca aaggcaaatg tccccaagtg
1261 agtgggctcc ccgctgtcac tgccagtcac ccacaggaag ggactggtga tgggctgtct
1321 ctacccggag cgtgcgggat tcagcaccag gctcttccca gtaccccaga cccactgtgg
1381 gtcttcccgt gggatgcggg atcctgagac cgaagggtgt ttggtttaaa aagaagactg
1441 ggcgtccgct cttccaggac ggcctctgtg ctgctggggt cacgcgaggc tgtttgcagg
1501 ggacacggtc acaggagctc ttctgccctg aacgctccca acctgcctcc cgcccggaag
1561 ccacaggacc cactcatgtg tgtgcccaca agtgtagtta gccgtccaca ccgaggagcc
1621 cccggaagtc cccactgggc ttcagtgtcc tctgccacat tccctgggag gaacaatgtc
1681 cctcggctgt tccggtgaaa agttgagcca cctttggaag acgcacgggt ggagtttgcc
1741 agaagaaagg ctgtgccagg gccgtgtttg gctacagggg ctgccggggc tcttggctct
1801 gcagcgagaa agacacagcc cagcagggct ggagacgccc atgtccagca ggcgcaggcc
1861 tggcaacacg gtccccagag tcctgagcag cagttaggtg catggagagg gtatcacctg
1921 gtggccacag tcccccttct cacctcagca atgatcccca aagtgagagg tggctccccc
1981 ggcccccacc accctcagca gccccacccc actcaaccct gagggtcccc agggtcctga
2041 tgaagacctc cgaccccagc gccaggctcc tcggagccca acagtcccaa gggggcagga
2101 gacggggtgg tccagtgctg aggggtacag ccctgggccc tgaccagccc cggcacctgc
2161 catgctggtt cccggaatga atcagctgct gactgtctcc agaagggctg gaaaggatgc
2221 tgccaggtga cccgaggtgc actcgcccca gggagatgga gtagacagcc tggcctggcc
2281 ctcgggacac attgtctgcc ccggggctat gggcaaatgc ccctccttct tacttcccag
2341 aatcccctga cattcccagg gtcagccagg acctgttaca gccctggtca cttggaactg
2401 acagctgtgt gaggcctgca cttctcagac ccagacttag aacaaaagga ggagtgagga
2461 ctcaaggcta caatgaggtt ccagtacttg ttacaagaaa ttggttttct gcaaaaaaag
2521 tccctacctg agcctttagg tgaatgtggg atccactccc gcttttaaca tgaaagcatt Fig. 29-2 – SEQ ID NO: 3265 ICOSLG 2581 agaagatgtg tggtgtttat aaaagaacag ttgtcatcac cgggcattga ttggcaggga
2641 caaggagctg cttgggtgtg gaaagttggg gcgttggaaa gtgggctgtg gtgcccattt
2701 gcagtgactg tgaagtgact ccaggacgga cctgcggggg cacccagagg tcctaagccc
2761 caggactgag ggtcgtgcat caccactcgg gtgtcccggg aggtgccctg ggcccgggga
2821 cctcacaggc aggacggcga cactaatgca gggagaggga gtctggcccc agcttttcct
2881 atcagaggcg attttccttc accaggggat gggcaggaaa gaggcagggg ccccagaagc
2941 ttctgtccct catgcctgag ggcacggggg acacttggag gctgctgtca ccactgtgcg
3001 tccaaggcca tgctctctgc gggtcagtgc ctgagtctcg cctccctgct ggtccctgaa
3061 gccccctcag aagccctgcc tgtcacgtcg gcatttgtga gacctaccct gtaacgcctg
3121 cccctctcag cccaacatca gcttcctctt tctcccttgc tgtagacagg ctggattcca
3181 gtgttgggac agccatctcc agaaacctga cttaagagag taagatgcaa atcgtgcctg
3241 tatccagtgg ctttggtggg tgcagggagt cttgggcaca gccagctcag ctgtctgtgg
3301 tatgagcagg aacaggtgcc actcctgctc aggggaccct gccctacacc aggctgttcc
3361 gtccccctgg aggacatggg gccaggtctg gaggcatttt gggttgtcac agctgggggc
3421 tgttcctcgg cttcagcggg tggaagcctc agatgctgtt caacatcttc tggacacggg
3481 aggccccgac agagagaagc gtccacccgc aagtccacag tctgaggtct cccctcagag
3541 accctgccct gcacacccac ctccagccaa aggtcctgcc tgccccaggg ctcaggggaa
3601 ccttgccggt ctgtggaaca ggagagggga ctctcgccag ctgcaccacc ctgcacgtag
3661 taggtgtgcg gtaaacatcc accagggagg ctccagtcaa ggctggcaga tggggcggtc
3721 catccctagg gcaggtgaca gaagggaaaa ggctgcctgc tggcccccga gccaggtagc
3781 acatgcttgt gcctcagttt cccctcctgt aaagtgaggc gctggatcca ggttctgtct
3841 actgggctct gcagcttgga cgctcctaag accaagcgac ccaccctggg gagggcagct
3901 atggctttgg aatagctgtc caggcccggg tgcctccaag acggccacca caccctgcct
3961 gtgctgcagg ggtgcagggg taaggggcaa gactccagag gcctcctctc tgcatctcct
4021 tgtcttcagt ggccggaggt gaggcctgag ctcaggggag gggcttctgc cacgaaccct
4081 atggcggggc acagcacact tttcccaggg aggacccctg ggccccctgc attatcccca
4141 gcggagtgtg gggtcacctt ccaagagcga cattgagaag ctccagctct aggagtgtgc
4201 agactcttaa ccaggcaggc ccaggccctg gggcacacaa aggcggggcc tgctctcccc
4261 agctgcccct gccaatgggg gctggactgt cctaccctcc tcccttctac ctccccactg
4321 tcttccctct ccactgtcac cactgcctcc ctcttccact gtcctccatg cactgccctc
4381 cctccacctt cccccacccc caccactccc catgctgtcc ccaggctccc cccgctctcc
4441 cccctcccca ctgtccccct ccccatgctg tacccagctc accccgctct cccctctccc
4501 cactgtcccc cctcccactc cccatgctgt ccccagctca ccctacatgg acttggcgat
4561 gtccttccat ggctcaccgg tctgaatttc catgatgagc cgggcctgca gctttgctcc
4621 cctatccctg cccaggctgc agctgtccat gcagggagcg agctccagca cctgcggagt
4681 ccttccgtgg gggcctctcc gtgccacagc agccagggac ctcaggtgcc tgtgcatgac
4741 accaccgccc atcctcatcc tgagccagcc tctcaggatc aggacttggt ttggcggcgt
4801 taaccttaga gcctgcaagg ggcttcctcc tggtgggtct ggccgtagcc tggggaggcc
4861 acagctccag gccactccag acctcccttc ctctgggcct tccatgtggt ggcaaccacc
4921 gcagctgtaa gggagggaaa atggagcgtt tgttctcggg ctgggctggg gtctggggga
4981 agccatgggc gtgaagactg gagtattatt tgatggagaa gcggccactc ctggagaccg
5041 gcggcaaaca cagaagcaca gcgtggaagg tgctggtgtc agcccacacg ggtgatgggg
5101 tcagactcag gagtcacact caggagtcac caggctcaaa gggcccaggc accgcaagtc
5161 ctgctcagcc ccagacacaa tgcattcctg ttgccctcgc cctcagccag gccccacgca Fig. 29-3 – SEQ ID NO: 3265 ICOSLG 5221 ggccagggag cactggcaaa gcttggcaac cctctggggg ccagccttca tccaggccga
5281 aggtggtcag tggcccacca tggcccaggt agaaaactca cggattaaga tttcatgccc
5341 gactccaaag gcaagagact ttattatttt atttttttg agccagagta tcgctctgtc
5401 acctaggctg gagtgcaatc tctgctcatt gcaacatctg cctcccgaac tcaagcaatt
5461 ctgcctcagc ctcccaagta gctgggatta caggtgtgcg ccaccatgcc caggtaattg
5521 tatttttagt agagacaggg tttcaccatg ttggtcaggc tggtttcaaa ctcctgacct
5581 caaatgatct gcccacctcg acctcccaaa gtgctgggat tacaggtgcg agccaccgca
5641 cctggctacc agacacttca gagttacagg ttagtttttc tttttctttt attttttttt
5701 ttttggcgga ggtgcagggg gagttaaaca aacaaacaaa ataaacaggc cgggtgcggt
5761 ggctcatgcc tgtaatccca gcactttagg aggcctaggt gggtggatca cgagatcagg
5821 ggttcaagac cagcctggcc gagatggtaa aaccccgtct ccactaaaaa tacaaaaatt
5881 ggccaggcac ggtggctcac acctgtaatc ccagtacttt gggaggctga ggtgggcaga
5941 tcacctgagg tcaggagttc aagaccaacc tgaccaacat ggagaaaccc catctctact
6001 aaaaatacaa aattagccag gtgtggtggt gcatgcctgt aattccagct actcgggagg
6061 ctgaggcagg agaattgctt gaacccagga ggcagaggtt gcagtgggcc aagatggcgc
6121 cattgcactc cagcctggga acaagagcga aactctgact aaaaaagaaa gaaagaaaga
6181 aaaaaattag ttgggcacgg tggcaggcgc ctgtaatccc aggtactcag gaggctgagg
6241 caggagaatt gcttgaaccc gggaggcaga ggtcgcagtg agccgagatt gcaccactgc
6301 cctccagcct gggtgacaga gcaagactcc gtctcaaaaa aaaaaaaaaa aaaaattgga
6361 tacattgtaa tacctcaaat acttgtaagt gaagcacccc agttcccata gagctgccgc
6421 actcagaggc ttctgtaacc tgcctgctcc cagcattcta tttagggtct ggtatgtcca
6481 gaatttgcag acacagcaat tcctgcagca gcagtgcacc atgtggaagg ggccccatga
6541 ccagcccact gtgagctcac acgtgatgac tgaggcttct tcacacagca gggctctggg
6601 tgtgataccc agggcacacg cgtttgcaca ggcacaggcc acacaagttc tcacatgctc
6661 agccccataa gccgtgctgg acaggcatgg ccatttacac ccaggatcct gctgagaaca
6721 gcaaccaact caccaccctc gcatcatgat ccttgccaca caggggctct ggtggctttg
6781 gtggcctggg ctgtggctct gctgccagcc accttgagtg aagatccggg ttctctgggt
6841 gctactcagc tgctatgtgg ggagctggcc cctggggtga tgagggccct tcccaacccg
6901 ccctcagccc ttggacagcc aggatcaccc ggggctgtct gcatacagac ttctcagggg
6961 agttctcagc ttggaccctt atctccccag aatcctggaa cctgctcctt ctgctctcgt
7021 gactgactgt gttctctatg caacttccaa taaaacctct tcatttgaaa ggaaaaaa Fig. 30 – SEQ ID NO: 3266 C21orf33

C21orf33-Hs01105802_g1 NM_004649 1584BP

1 gctgtcctca ccgcaatggc ggctgtgagg gtcctggtgg cctcgaggct cgctgcggca
61 tctgcattca cgtccctgtc ccccggcggt cggacgcctt cccagcgcgc agcccttcac
121 ctctccgtgc cgcgccccgc ggccagggtc gcgctggtgc tgtctggatg cggagtctac
181 gatgggaccg agatccacga ggcctcggcg atcctggtgc acctgagccg tggaggggct
241 gaagtccaga tctttgctcc tgacgtccct cagatgcacg tgattgacca caccaagggg
301 cagccgtccg aaggcgagag caggaatgtt ttgaccgagt ctgcgaggat cgcccgtggc
361 aaaatcacag acctggccaa cctcagtgca gccaaccatg atgctgccat ctttccagga
421 ggctttggag cggctaaaaa cctgagcacg tttgccgtgg acgggaaaga ttgcaaggtg
481 aataaagaag tggagcgtgt cctgaaggag ttccaccagg ccgggaagcc catcggcttg
541 tgctgcattg cacctgtcct cgcggccaag gtgctcagag gcgtcgaggt gactgtgggc
601 cacgagcagg aggaaggtgg caagtggcct tatgccggga ccgcagaggc catcaaggcc
661 ctgggtgcca agcactgcgt gaaggaagtg gtcgaagctc acgtggacca gaaaaacaag
721 gtggtcacga ccccagcctt catgtgcgag acggcactcc actacatcca tgatgggatc
781 ggagccatgg tgaggaaggt gctggaactc actggaaagt gacgcgcatg gacggggccc
841 agctaggcgc caggacttgg cctcaccctc tggctgagga gctgtcggct gctttccatc
901 cagctgggag tctggcaggc cctttttttt ttttctttgc cgaaacctgc aggcgttctc
961 tctctaagga ggatgtgctg cagtgcatgg gggatgtttc ttcctgggtg tggctgggct
1021 gctctcacat acagaggccg aggggccaat tcgttctctg ccacagggac ttgcctcact
1081 gtgtcccaaa aacaaatcgc agccagcttt tccagaaata gaaaattctg ccgtctgagg
1141 ttttatactt caggttagtt agtttttgga aggaagaaca tttttaggtt tgcaagcctc
1201 ctgatcagga aaccagaaat accacattta tggaccatga aaggttggtt cttgactctg
1261 aagggacttt tgagttaatc agcgtaaggg gatttctaaa gcaggcaatc cctgtagccg
1321 cagagaataa acgccttccc aaaatggcaa cttcccacag ccacatttca gacctgctga
1381 gactgctgag tgaggaatgg cagtgaggtt tcttcaatta gtctcagttc tcttaatttt
1441 caggaagaaa gggaaattgc agcccctcag cccccaggat tgacctctgg ggagtgatgg
1501 tagcgttggt gccaggccgt gggttcaggt gtggcagaag cttgcagatg cgtccgaagg
1561 gaaataaagt gtgttggcgt taga Fig. 31-1 – SEQ ID NO: 3267 ADAMTS5

ADAMTS5-Hs04272736_s1 NM_007038 9621BP

1 acagcgctcg cgctgctctc ggcgctcgca gctgccgact ggggatgacg gcgggcagga
61 ggagaccgca gccgaaggga cacagacacg ccgcttcacc agctcgcctc aggctgcccc
121 cctgcatttt tgttttaatt tttacggctt tttcccctct ctttcttccc ttcctcctgg
181 tcccagcaga gccaaggaaa cccacaaaat aagaaaggaa gtgggccccg gagcttggaa
241 cctccacagc cggcttgtcc agcgcagcgc gggggcggga ggctgcgcgc accagttgcc
301 agcccggtgc gcggtacctt tccttacttt tcttgaaaca gcgatcgtgc ctgcatttgg
361 tggttttttg gtttttgttt ttttcctttt cccgtatttg ctgaatctcc actatccgac
421 tttttttttt taatcttttc tttccccccc cccccacccc acctctttct ggagcacgaa
481 tccaaacatt ttcccaagca acaaagaaaa gttcgcacgc tggcaccgca gcccggacag
541 gctggcgctg ctgccgggcc cccctccctc cgacacttga ctcaatcctg caagcaagtg
601 tgtgtgtgtc cccatccccc gccccgttaa cttcatagca aataacaaat acccataaag
661 tcccagtcgc gcagcccctc cccgcgggca gcgcactatg ctgctcgggt gggcgtccct
721 gctgctgtgc gcgttccgcc tgcccctggc cgcggtcggc cccgccgcga cacctgccca
781 ggataaagcc gggcagcctc cgactgctgc agcagccgcc cagccccgcc ggcggcaggg
841 ggaggaggtg caggagcgag ccgagcctcc cggccacccg caccccctgg cgcagcggcg
901 caggagcaag ggctggtgc agaacatcga ccaactctac tccggcggcg gcaaggtggg
961 ctacctcgtc tacgcgggcg gccggaggtt cctcttggac ctggagcgag atggttcggt
1021 gggcattgct ggcttcgtgc ccgcaggagg cgggacgagt gcgccctggc gccaccggag
1081 ccactgcttc tatcggggca cagtggacgg tagtccccgc tctctggctg tctttgacct
1141 ctgtgggggt ctcgacggct tcttcgcggt caagcacgcg cgctacaccc taaagccact
1201 gctgcgcgga ccctgggcgg aggaagaaaa ggggcgcgtg tacggggatg ggtccgcacg
1261 gatcctgcac gtctacaccc gcgagggctt cagcttcgag gccctgccgc cgcgcgccag
1321 ctgcgaaacc cccgcgtcca caccggaggc ccacgagcat gctccggcgc acagcaaccc
1381 gagcggacgc gcagcactgg cctcgcagct cttggaccag tccgctctct cgcccgctgg
1441 gggctcagga ccgcagacgt ggtggcggcg gcggcgccgc tccatctccc gggcccgcca
1501 ggtggagctg cttctggtgg ctgacgcgtc catggcgcgg ttgtatggcc ggggcctgca
1561 gcattacctg ctgaccctgg cctccatcgc caataggctg tacagccatg ctagcatcga
1621 gaaccacatc cgcctggccg tggtgaaggt ggtggtgcta ggcgacaagg acaagagcct
1681 ggaagtgagc aagaacgctg ccaccacact caagaacttt tgcaagtggc agcaccaaca
1741 caaccagctg ggagatgacc atgaggagca ctacgatgca gctatcctgt ttactcggga
1801 ggatttatgt gggcatcatt catgtgacac cctgggaatg gcagacgttg ggaccatatg
1861 ttctccagag cgcagctgtg ctgtgattga agacgatggc ctccacgcag ccttcactgt
1921 ggctcacgaa atcggacatt tacttggcct ctcccatgac gattccaaat tctgtgaaga
1981 gacctttggt tccacagaag ataagcgctt aatgtcttcc atccttacca gcattgatgc
2041 atctaagccc tggtccaaat gcacttcagc caccatcaca gaattcctgg atgatggcca
2101 tggtaactgt ttgctggacc taccacgaaa gcagatcctg ggccccgaag aactcccagg
2161 acagacctac gatgccaccc agcagtgcaa cctgacattc gggcctgagt actccgtgtg
2221 tcccggcatg gatgtctgtg ctcgcctgtg gtgtgctgtg gtacgccagg gccagatggt
2281 ctgtctgacc aagaagctgc ctgcggtgga agggacgcct tgtggaaagg ggagaatctg
2341 cctgcagggc aaatgtgtgg acaaaaccaa gaaaaaatat tattcaacgt caagccatgg
2401 caactgggga tcttggggat cctggggcca gtgttctcgc tcatgtggag gaggagtgca
2461 gtttgcctat cgtcactgta ataaccctgc tcccagaaac aacggacgct actgcacagg
2521 gaagagggcc atctaccgct cctgcagtct catgccctgc ccacccaatg gtaaatcatt Fig. 31-2 – SEQ ID NO: 3267 ADAMTS5

2581 tcgtcatgaa cagtgtgagg ccaaaaatgg ctatcagtct gatgcaaaag gagtcaaaac
2641 ttttgtggaa tgggttccca aatatgcagg tgtcctgcca gcggatgtgt gcaagctgac
2701 ctgcagagcc aagggcactg gctactatgt ggtatttttct ccaaaggtga ccgatggcac
2761 tgaatgtagg ctgtacagta attccgtctg cgtccggggg aagtgtgtga gaactggctg
2821 tgacggcatc attggctcaa agctgcagta tgacaagtgc ggagtatgtg gaggagacaa
2881 ctccagctgt acaaagattg ttggaacctt taataagaaa agtaagggtt acactgacgt
2941 ggtgaggatt cctgaagggg caacccacat aaaagttcga cagttcaaag ccaaagacca
3001 gactagattc actgcctatt tagccctgaa aaagaaaaac ggtgagtacc ttatcaatgg
3061 aaagtacatg atctccactt cagagactat cattgacatc aatggaacag tcatgaacta
3121 tagcggttgg agccacaggg atgacttcct gcatggcatg ggctactctg ccacgaagga
3181 aattctaata gtgcagattc ttgcaacaga ccccactaaa ccattagatg tccgttatag
3241 cttttttgtt cccaagaagt ccactccaaa agtaaactct gtcactagtc atggcagcaa
3301 taaagtggga tcacacactt cgcagccgca gtgggtcacg ggcccatggc tcgcctgctc
3361 taggacctgt gacacaggtt ggcacaccag aacggtgcag tgccaggatg gaaaccggaa
3421 gttagcaaaa ggatgtcctc tctcccaaag gccttctgcg tttaagcaat gcttgttgaa
3481 gaaatgttag cctgtggtta tgatcttatg cacaaagata actggaggat tcagcactga
3541 tgcagtcgtg gtgaacagga ggtctaccta acgcacagaa agtcatgctt cagtgacatt
3601 gtcaacagga gtccaattat gggcagaatc tgctctctgt gaccaaaaga ggatgtgcac
3661 tgcttcacgt gacagtggtg accttgcaat atagaaaaac ttgggagtta ttgaacatcc
3721 cctgggctta caagaaacac tgatgaatgt aaaatcaggg gacatttgaa gatggcagaa
3781 ctgtctcccc cttgtcacct acctctgata gaatgtcttt aatggtatca taatcatttt
3841 cacccataat acacagtagc ttcttcttac tgtttgtaaa tacattctcc cttggtatgt
3901 cactttatat cccctggttc tattaaaata tccatatata tttctataaa aaaagtgttt
3961 gaccaaagta ggtctgcagc tatttcaact tccttccgtt tccagaaaga gctgtggata
4021 ttttactgga aattaagaac ttgctgctgt tttaataaga tgtagtatat tttctgacta
4081 caggagataa aatttcagtc aaaaaaccat tttgacagca agtatcttct gagaaatttt
4141 gaaaagtaaa tagatctcag tgtatctagt cacttaaata catacacggg ttcatttact
4201 taaacctttg actgcctgta tttttttcag gtagctagcc aaattaatgc ataatttcag
4261 atgtagaagt agggtttgcg tgtgtgtgtg tgatcatact caagagtcta aaaactagtt
4321 tccttgtgtt ggaaatttaa aaggaaaaaa atcgtatttc actgtgtttt caatttatat
4381 tttcacaact actttctctc tccagagctt tcatctgata tctcacaatg tatgatatac
4441 gtacaaaaca cacagcaagt tttctatcat gtccaacaca ttcaacactg gtatacctcc
4501 taccagcaag cctttaaaat gcatttgtgt ttgcttattt gttttgttca agggttcagt
4561 aagacctaca atgttttgta tttcttgact tattttatta gaaacattaa agatcacttg
4621 gtagttagcc acattgagaa gtggttatca ttgttaatgt ggttaatgcc aaaaagtggt
4681 taatattaat aagactgttt ccacaccata ggcaataatt tcttaattta aaaaatctaa
4741 gtatattcct attgtactaa atatttttcc caactggaaa gcacttgatt gtacccgtaa
4801 gtgtttgagt gatgacatgt gatgattttc agaaagttgt tgtttttgtt tccatagcct
4861 gtttaagtag gttgtaagtt tgaatagtta gacatggaaa ttattttata agcacacacc
4921 taaagatatc tttttagatg ataaaatgta cacccccccca tcaccaacct cacaacttag
4981 aaaatctaag ttgtttgatt tctttgggat ttcttttgtt gtgaaacact gcaaagccaa
5041 tttttcttta taaaaattca tagtaatcct gccaaatgtg cctattgtta aagatttgca
5101 tgtgaagatc ttagggaacc actgtttgag ttctacaagc tcatgagagt ttatttttat
5161 tataagatgt ttttaatata aaagaattat gtaactgatc actatattac atcatttcag Fig. 31-3 – SEQ ID NO: 3267 ADAMTS5

5221 tgggccagga aaatagatgt cttgctgttt tcagtatttt cttaagaaat tgcttttaaa
5281 acaaataatt gttttacaaa accaataatt atcctttgaa ttttcataga ctgactttgc
5341 ttttgacgta gaaatttttt ttctcaataa attatcactt tgagaaatga ggcctgtaca
5401 aggctgataa cctatatgtg atggagatca cccaatgcca agggcagaaa gcaaacctag
5461 ttaaataggt gagaaaaaaa ataataatcc cagtgccatt tgtctgtgca aagagaatta
5521 ggagagaggt taatgttact tttttccatt ttggaaataa ttttaatcaa gtaactcaaa
5581 tgtgacaaaa tttattttta ttttttgtgg ttatattccc aacaacatta aaaaatactc
5641 gaggcataaa tgtagttgtc tcctactctg cttctcttac tatactcata cattttttaat
5701 atggtttatc aatgattcat gtttccctca aatagtgatg gtttacacct gtcatggaaa
5761 caatcctaga gagctcagag caattaaacc actattccat gcttttaagt agttttctcc
5821 acctttttct tatgagtctc actagattga ctgaggaatg tatgtctaaa ttcctggaga
5881 agatgatatg gattggaaac tgaaattcag agaaatggag tgttcaatag ataccacgaa
5941 ttgtgaacaa agggaaaatt ctatacaact caatctaagt cagtccactt tgacttcgta
6001 ctgtctttca cctttccatt gttgcatctt gaatttttta aaatgtctag aattcaggat
6061 gctaggggct acttctttaa aaaaaaaaaa aaaaaagaat tcgtctgaaa atgctcaggt
6121 ttgtaagaat ctaatctcac ttacataact aagcactcca taataagttt tattaagtac
6181 aaagggagcc agaaaaaatg acatttattt cttctagatc agaaaaattt aaattaagcc
6241 ctgccttgct gtttagaaat atgtgggcat tgttataatt tattcaataa atttatgttc
6301 ctttgccttc ctgtggaaac agttttatcc cactaaacta ggaattaggg gataaatcac
6361 aaacaaaaaa aaagttgcag cactgaaaaa aagtaattta ttgtttttgc aactggtatg
6421 tgaatttgtg tgataaaatt atttattctt atttaacaaa aatatgttca aatttttcta
6481 tatttaaaat gttttgctgt tgtcctactt tttaatttat gcttcatgtt tgtgtataaa
6541 gtacactttt acactttgtg agtttacata atatacagca ctggttgctt ttgtattttt
6601 ttacagaaag ctttctgtgt gaagcaggtg tatatgtata tattcctcat gtattcttat
6661 tctgatacta tcatttttct ttccaaggaa attttaatct gtcatgacca atagtgttca
6721 ttacttgtgc ctatgataat aggtttttta catcacatta acactatttt ttccaagtca
6781 caaataagaa aaacacttat tcaatgaaac aaggtgcaag ttttaaattt gggtacacaa
6841 atagcctaga agcttcctac agacgctaag acacagccaa taatcagatc ctttcacttc
6901 atcgagaaac ttggacaagt cgatattgat gtattagatg aaagttgtct acacacaact
6961 tctgagggat acaaacgata ataaaaccaa atgttgtctg tttctccttt agaaacacct
7021 cctaaaatta atatcattta gtctctagtg tctgtaggat tctacagatg agcacaaata
7081 gattgggttt gtataacaaa tgctaatagt cataactgtt tctacaaata tggggtgtcc
7141 attaagagaa tgtgatgttt tcctactgct gttgaatccc atggggtgat tataggactt
7201 gaaataggca gagtcacctc tgatgacatc agcttgcctc tgtgatttca cagtctgatc
7261 ctggcaacaa gacaaagcac ccttggacac acagccaatc tctggttgtg atatttcccc
7321 attgattcct tccttgttaa caaggtcatt ttaatggttc aggtgaggac agcagccaga
7381 ttcaaagtcc agaatttgtg ctgttacata gagttcacac tgtcaaataa cattgaattt
7441 aataatgatc aaatttttct agtagtcttt ggcagagtgt ataatctcat tggcatgatt
7501 ggtgaatatt actaatctct ttataatgaa agatgcttta caaatacctt atatttgcta
7561 acatttcaaa actactaaat aaatgaaata gccatgtgta cagaaatggt catttaaagc
7621 tttaatagaa ccaaattcaa gacaatgtat catttagaca cacagaaaag gaacttgtat
7681 gttttcccta ttattttttct catttgccaa caatctatag ttttaggtta tcaaacagat
7741 agatcaactt aactggctag tacattgaaa aatcttccta agaatccttt gttagcataa
7801 tctatagaga taatttctca aattatatca tcatgatgca tataaactct ataatgtata Fig. 31-4 – SEQ ID NO: 3267 ADAMTS5

5221 tgggccagga aaatagatgt cttgctgttt tcagtatttt cttaagaaat tgcttttaaa
5281 acaaataatt gttttacaaa accaataatt atcctttgaa ttttcataga ctgactttgc
5341 ttttgacgta gaaatttttt ttctcaataa attatcactt tgagaaatga ggcctgtaca
5401 aggctgataa cctatatgtg atggagatca cccaatgcca agggcagaaa gcaaacctag
5461 ttaaataggt gagaaaaaaa ataataatcc cagtgccatt tgtctgtgca aagagaatta
5521 ggagagaggt taatgttact tttttccatt ttggaaataa ttttaatcaa gtaactcaaa
5581 tgtgacaaaa tttattttta tttttgtgg ttatattccc aacaacatta aaaaatactc
5641 gaggcataaa tgtagttgtc tcctactctg cttctcttac tatactcata catttttaat
5701 atggtttatc aatgattcat gtttccctca aatagtgatg gtttacacct gtcatggaaa
5761 caatcctaga gagctcagag caattaaacc actattccat gcttttaagt agttttctcc
5821 accttttct tatgagtctc actagattga ctgaggaatg tatgtctaaa ttcctggaga
5881 agatgatatg gattggaaac tgaaattcag agaaatggag tgttcaatag ataccacgaa
5941 ttgtgaacaa agggaaaatt ctatacaact caatctaagt cagtccactt tgacttcgta
6001 ctgtctttca cctttccatt gttgcatctt gaatttttta aaatgtctag aattcaggat
6061 gctaggggct acttctttaa aaaaaaaaaa aaaaaagaat tcgtctgaaa atgctcaggt
6121 ttgtaagaat ctaatctcac ttacataact aagcactcca taataagttt tattaagtac
6181 aaagggagcc agaaaaaatg acatttattt cttctagatc agaaaaattt aaattaagcc
6241 ctgccttgct gtttagaaat atgtgggcat tgttataatt tattcaataa atttatgttc
6301 ctttgccttc ctgtggaaac agttttatcc cactaaacta ggaattaggg gataaatcac
6361 aaacaaaaaa aaagttgcag cactgaaaaa aagtaattta ttgtttttgc aactggtatg
6421 tgaatttgtg tgataaaatt atttattctt atttaacaaa aatatgttca aatttttcta
6481 tatttaaaat gttttgctgt tgtcctactt tttaatttat gcttcatgtt tgtgtataaa
6541 gtacactttt acactttgtg agtttacata atatacagca ctggttgctt ttgtattttt
6601 ttacagaaag ctttctgtgt gaagcaggtg tatatgtata tattcctcat gtattcttat
6661 tctgatacta tcatttttct ttccaaggaa attttaatct gtcatgacca atagtgttca
6721 ttacttgtgc ctatgataat aggtttttta catcacatta acactatttt ttccaagtca
6781 caaataagaa aaacacttat tcaatgaaac aaggtgcaag ttttaaattt gggtacacaa
6841 atagcctaga agcttcctac agacgctaag acacagccaa taatcagatc ctttcacttc
6901 atcgagaaac ttggacaagt cgatattgat gtattagatg aaagttgtct acacacaact
6961 tctgagggat acaaacgata ataaaaccaa atgttgtctg tttctccttt agaaacacct
7021 cctaaaatta atatcattta gtctctagtg tctgtaggat tctacagatg agcacaaata
7081 gattgggttt gtataacaaa tgctaatagt cataactgtt tctacaaata tggggtgtcc
7141 attaagagaa tgtgatgttt tcctactgct gttgaatccc atggggtgat tataggactt
7201 gaaataggca gagtcacctc tgatgacatc agcttgcctc tgtgatttca cagtctgatc
7261 ctggcaacaa gacaaagcac ccttggacac acagccaatc tctggttgtg atatttcccc
7321 attgattcct tccttgttaa caaggtcatt ttaatggttc aggtgaggac agcagccaga
7381 ttcaaagtcc agaatttgtg ctgttacata gagttcacac tgtcaaataa cattgaattt
7441 aataatgatc aaatttttct agtagtcttt ggcagagtgt ataatctcat tggcatgatt
7501 ggtgaatatt actaatctct ttataatgaa agatgcttta caaatacctt atatttgcta
7561 acatttcaaa actactaaat aaatgaaata gccatgtgta cagaaatggt catttaaagc
7621 tttaatagaa ccaaattcaa gacaatgtat catttagaca cacagaaaag gaacttgtat
7681 gttttcccta ttatttttct catttgccaa caatctatag ttttaggtta tcaaacagat
7741 agatcaactt aactggctag tacattgaaa aatcttccta agaatccttt gttagcataa
7801 tctatagaga taatttctca aattatatca tcatgatgca tataaactct ataatgtata Fig. 31-5 – SEQ ID NO: 3267 ADAMTS5

7861 attgtgtttc atttatttaa tgtatgagaa catattgaaa tacaaaacca tgcattagcc
7921 aaaaaattgg aatacaggta gtgttcagat cagcaaaaca ttcagtctgg taaatgcctg
7981 cctggggcta tgatatcatt ctcaatgcag gttttatgga aaaactaaaa gaatatgttg
8041 ttagatgatg ttggttttga aaaaaaaaag acattaacat acacattagt tagcccagtt
8101 aattgcattc tactaatata gttgcacatt agcaataatt ttgctgtctc tggtctttat
8161 tttgtggctt caactaactg gaccatgtgg actgtaaagg tcaaatggaa aaaacgagca
8221 gtggcccctc atcctgtaag gtactgctac atcagagtga cctaaaagtc taacactgtg
8281 aggaaaactg tgatttgtag gaaaaaaaaa aaaaacaaat aaaaaacagg gcatgctttt
8341 taattttttt ccactttcct ttggcacacc caatgaacaa ttctaatttt tattgaggtg
8401 ctaacatctt tcgtgaccga ctgtcaaatg tggtattttt gagttactat ttttctacat
8461 gattttacag tttgcaagaa agacctctaa gctttgtgtc acggtagggc acaacttgat
8521 actcaaaatt tgaaaaataa gcacatccaa tgattgtttt gaccaacagt ggtcagtgac
8581 gtaaactgca tgtgcatctg aggacattta aggggtcatt aaaatttgag gagcatcagg
8641 ccggagtagc agacttttag atgagtcata tttcagcatt cactaagtcc tcagcattcc
8701 attcaaactg tcgtgtatat ttggcctgat ttttttcaa gctttgcaat aatttatgtt
8761 attggtaaac acttggtgac tatatctcag ccttttcttt aacaactcac aatatattag
8821 aaacacgtct acctatactg agagtatatt tacaatagaa gaacatactg tatgtgactt
8881 tgtaaagcta gacttttgat taagaaatat ataatctctg gatgctattt ttgcattata
8941 cactcaggca caacgtaaac cttgatggct catcttgcta caattacgag ttgaaaaaca
9001 ctacttacgt atttgtatga cctattagtc agaggaaatc atacatatgc tttgtaaata
9061 gactttgcag ataactaaat agactgaaga aatatgttgc atttgataga agcaattgca
9121 taaatatttg gtttctatat tagagtctgt gagtaaagtc aagtaataaa cctaagtagg
9181 tataacagat ttttaaacct tgaaacttgc tttgatggta gagaaaatca ttgaagattt
9241 acatactgta tataagatgt aaaatgtacg ctgcttatta ccctcaattt tccagaagca
9301 atggtatata atgcagttga aaaaccaaaa atcttggaaa actaagacgg gtcttgttta
9361 aaatgtctct cagctttggc aaccttcaaa tcttaatcaa ctatttaaag cattactgtg
9421 tcttgtagcc tgcattccac aacagctctg ttattcaggt aaaagacttg aactgagccg
9481 tttgggacct atactgtaat attttcattg aggaacaata tcctattttg taaagcattt
9541 ccctatgtgt gactttaaac tgtaaaatta aacactgctt ttgtgggttc agtgggcata
9601 ataaatataa attgtaaact a Fig. 32-1 – SEQ ID NO: 3268 CXADR

CXADR-Hs04194411_s1 NM_001338 5593BP

1 agtcgggagc gcgcgaggcg cggggagcct gggaccagga gcgagagccg cctacctgca
61 gccgccgccc acggcacggc agccaccatg gcgctcctgc tgtgcttcgt gctcctgtgc
121 ggagtagtgg atttcgccag aagtttgagt atcactactc ctgaagagat gattgaaaaa
181 gccaaagggg aaactgccta tctgccatgc aaatttacgc ttagtcccga agaccaggga
241 ccgctggaca tcgagtggct gatatcacca gctgataatc agaaggtgga tcaagtgatt
301 attttatatt ctggagacaa aatttatgat gactactatc cagatctgaa aggccgagta
361 cattttacga gtaatgatct caaatctggt gatgcatcaa taaatgtaac gaatttacaa
421 ctgtcagata ttggcacata tcagtgcaaa gtgaaaaaag ctcctggtgt tgcaaataag
481 aagattcatc tggtagttct tgttaagcct tcaggtgcga gatgttacgt tgatggatct
541 gaagaaattg gaagtgactt taagataaaa tgtgaaccaa aagaaggttc acttccatta
601 cagtatgagt ggcaaaaatt gtctgactca cagaaaatgc ccacttcatg gttagcagaa
661 atgacttcat ctgttatatc tgtaaaaaat gcctcttctg agtactctgg gacatacagc
721 tgtacagtca gaaacagagt gggctctgat cagtgcctgt tgcgtctaaa cgttgtccct
781 ccttcaaata aagctggact aattgcagga gccattatag gaactttgct tgctctagcg
841 ctcattggtc ttatcatctt ttgctgtcgt aaaaagcgca gagaagaaaa atatgaaaag
901 gaagttcatc acgatatcag ggaagatgtg ccacctccaa agagccgtac gtccactgcc
961 agaagctaca tcggcagtaa tcattcatcc ctggggtcca tgtctccttc caacatggaa
1021 ggatattcca agactcagta taaccaagta ccaagtgaag actttgaacg cactcctcag
1081 agtccgactc tcccacctgc taaggtagct gcccctaatc taagtcgaat gggtgcgatt
1141 cctgtgatga ttccagcaca gagcaaggat gggtctatag tatagagcct ccatatgtct
1201 catctgtgct ctccgtgttc ctttcctttt tttgatatat gaaaacctat tctggtctaa
1261 attgtgttac tagcctcaaa atacatcaaa aaataagtta atcaggaact gtacggaata
1321 tatttttaaa aatttttgtt tggttatatc gaaatagtta caggcactaa agttagtaaa
1381 gaaaagttta ccatctgaaa aagctggatt ttctttaaga ggttgattat aaagttttct
1441 aaatttatca gtacctaagt aagatgtagc gctttgaata tgaaatcata ggtgaagaca
1501 tgggtgaact tacttgcata ccaagttgat acttgaataa ccatctgaaa gtggtacttg
1561 atcattttta ccattatttt taggatgtgt atttcattta tttatggccc accagtctcc
1621 cccaaattag tacagaaata tccatgacaa aattacttac gtatgtttgt acttggtttt
1681 acagctcctt tgaaaactct gtgtttggaa tatctctaaa aacatagaaa acactacagt
1741 ggtttagaaa ttactaattt tacttctaag tcattcataa accttgtcta tgaaatgact
1801 tcttaaatat ttagttgata gactgctaca ggtaataggg acttagcaag ctcttttata
1861 tgctaaagga gcatctatca gattaagtta gaacatttgc tgtcagccac atattgagat
1921 gacactaggt gcaatagcag ggatagattt tgttggtgag tagtctcatg ccttgagatc
1981 tgtggtggtc ttcaaaatgg tggccagcca gatcaaggat gtagtatctc atagttccca
2041 ggtgatattt ttcttattag aaaaatatta taactcattt gttgtttgac acttatagat
2101 tgaaatttcc taatttattc taaattttaa gtggttcttt ggttccagtg ctttatgttg
2161 ttgttgtttt tggatggtgt tacatattat atgttctaga aacatgtaat cctaaattta
2221 ccctcttgaa tataatccct ggatgatatt ttttatcata aatgcagaat aatcaaatac
2281 attttaagca agttaagtgt cctccatcaa ttctgtattc cagacttggg aggatgtaca
2341 gttgctgttg tgtgatcaaa catgtctctg tgtagttcca gcaaatcaag ctgagctttg
2401 aaaaagtttg tcttagtttt gtgaaggtga tttattctta aaaaaaaaaa agaaagaaaa
2461 agaaaaaaag ataagaagga ggagtaaagg gactactcct ccttgccaaa tgtgctaaat
2521 atcattttag gagaagaaag tgggtttatt gtatttccct taagattgtg agggagtgtg Fig. 32-2 – SEQ ID NO: 3268 CXADR 2581 gatacagtag aatgagccaa cagtttcttt ataataaata cggtctgcaa taaattattt
2641 cactagctct aaaacctttc cctagatttt agtagggagt tggtttctgt taatatcttt
2701 gggtgctgtg gtggtaaatg ctatattatg aacggtggca tgtatttaca gttagagtat
2761 tgtgtgtaca ctttttaatg gtaaacttaa gctgaatgtg taatggattt gtgtatagtt
2821 ttacatattt ggaagcattt taaaaacagg ttttaacctt atgtaaaatt acttttatac
2881 tcgtgttaac attttcatct gtgccttttg gtaatttaat ttctattatg aatttctggt
2941 gcctatgagc tagctatcac ctacctgaaa ggtgcttaga ggtgaaggta ctgtttctaa
3001 aaacacatca ctgtgatacc tttctatcct cacattttca agcttgcctc ttttctgttc
3061 tttgtggata taacttaagc aattgtgtta ttcataaagg tttagaaatt tcaatattcc
3121 caacactcta tgtttctgat tttataacag tagccatttt tgaaagtcag atgtttggcc
3181 tgttttatat gaataaagtt tatttataaa atattataaa aaataagtaa ataaacagaa
3241 cattaataat aaagttttgg ttcttcctat tcctgacttt catataatga aaattatcct
3301 attgatctaa gtagaagtta tcatagaaag tggacacgta taagactttc cttccttttt
3361 tttttaata acatatgagg aacaagactt ctcttcccat atacttcata ttttagagga
3421 cattgtttta aaggcttatg tctcactgta aaattctgtc agccaaatag taccaatacg
3481 ttttcaagta gttctcactg ataatttagt tgaaccagag atcaaatatt tgctcccgaa
3541 ttactactgg taatcaagta gttgaacaaa aaattactaa agcatttccg ttagatcagt
3601 caaggacagt actgcatctt tttttttttt ttttttttta agacggagtc tcggtctgtc
3661 acccaggctg gagtgcagtg gcgggatctc ggctcactgc aagctccgcc tcccaggttc
3721 acgccattct cctgcctcag cctcccgagc agctgggact acaggctccc atcaccacgc
3781 tcggctaagt ttttgtaatt ttagtagaga cagggtttca ccgtgttagc caggatggtc
3841 tcgatctcct gacctcgtga tctgcctgcc tcggcctccc aaagtgctgg gattacaggc
3901 gtgaaccact gcacccggcc cagtactgca tcttaacagc aaagccattt tattctactt
3961 tataactgag agacttgata ccatccatct ctttaggtta cagaggataa tttgaagaga
4021 aatgttactg tagaatatat agttctgtac tttttttttt tttttttaag agatagggtt
4081 tcactattgc tcaggctggt ctcaaactgc tgggctcagg agatcctcct gccttggcct
4141 cccaaattgc tgggattaca ggtgtgagcc gcagcatcca gccagttctg tactttgaat
4201 atggagtagt ttacagctat ttttttttct tactggtaat cttaactaat atgattccct
4261 tgttagagag cctctcactc ccccaccccc aaaaatgtct actattcatg acagtaacca
4321 attattctgg acaaattgct tctttttaat ttgagctatc tgccatggac tttctaaaat
4381 ggaaacacag cctgagtgta tcttagggag agtttgattg aaaaaatcca aatcactatc
4441 catatagatc atggatataa agagatacct gatttttatt aaaaagatac tttttcaaat
4501 ttaagagtta atcttggaaa tttggaacaa gtaaaggggc aagtaaacct tttgatgaaa
4561 tataaaagga actcattgca tgaagttgac tatcaaattc tgtgatgtgt ggcttcttaa
4621 aaatattctc agtgtctttt gtgtgcgtgc agcatgtaca tttgatgtta tgtgaatgtt
4681 gagtttttc ttctaatttt cacttcagca gtgtttaggg ctttcagatg ccttattcca
4741 gtgtgaacag aaaaagttca tattttatgt ggttaatgct ttgatgtgtc acataaagag
4801 tagtttgtag aaaatgttgg cacaatttta acttcttagt ggcttgtgac attatatatt
4861 atatatatat atgtacatat atctttataa cattcctgtg tttagtagtg taaatgttct
4921 gggcaagttt taatattttg aatgcctttg gatattccag caataaaggc atcatgttct
4981 gcaataggat ttcttactca tttacctatt ttaacactaa aatagaccac aactgagcac
5041 aaattccttt tataaatgtt atagaagcag ggaagaataa taaacacatt tgtgaattgt
5101 ggttcagttt atttatcttt agggaaggct gatcatttat cttatagcag ataaccccag
5161 cctcttattc attatggtta acttttataa tttatcttat tttataattt aagaatatag Fig. 32-3 – SEQ ID NO: 3268 CXADR 5221 tacatatcag ttgggtttgg ttttggtcat cgagactaaa agctccatca aaacagaact
5281 ttgtgttttc tgctaactta tttaatgaca caagttttaa gagaaccaca attcattgat
5341 tcacttattc ttttccctaa ttgtgaattt tagtgataaa tacacctgta ctactgagga
5401 aaatattctg acacttcacg tgtgcaaagt atagaactga cagtgtcagt ttcagatttt
5461 gtatgtacga tttctggctt atatatccaa tggtgcagat tttgaaattt gtaagaacaa
5521 aatttgttaa gaaaaacaac ttgctctagt tttgtgacct tgtgtacttt tgaaataaaa
5581 tcaagaaagc agt Fig. 33-1 – SEQ ID NO: 3269 PFKL

PFKL-Hs01040525_m1 NR_024108 (NM_001002021) 3401BP

1 gcggggacgg cgacgcggcg caggcggcgg gagtgcgagc tgggcccgtg tttcggccgc
61 cgccatggcc gcggtggacc tggagaagct gcgggcgtcg ggcgcgggca aggccatcgg
121 cgtcctgacc agcggcggcg acgcgcaagg tcccctgaca agcccaccag gcccccctgct
181 gagatggctg tgaccctggg ctgacccgcc cagtggcaca ttgactccgc ctggagctgg
241 ggagaccaga gaggccctgt ggttggacgg tggcctgggt gcgctgctcc tgccctctcc
301 ttgccctgcc tcagctgctg cctgccagag gcgtggcacc tcacctcaca cctgctccct
361 gctgctgagc cccacgccaa gctggagagc ggatgagaag catgtgtaac cagggtagag
421 gtcgagagtc ctctcgtggg ggtctccatg ttcaagggag ctgccgaggc ttgagcagga
481 gcccccagca ggaaactggc tttgccaagg cccccgctgg gacagactgt ttctttcact
541 gcagtcctgg gagccgaggg caaggggaca ggaaagagga agtgacctca gagcctggtg
601 gcaccagcat catgtccagg ctgggggggca tgaacgctgc tgtccgggct gtgacgcgca
661 tgggcattta tgtgggtgcc aaagtcttcc tcatctacga gggctatgag ggcctcgtgg
721 agggaggtga gaacatcaag caggccaact ggctgagcgt ctccaacatc atccagctgg
781 gcggcactat cattggcagc gctcgctgca aggcctttac caccagggag gggcgccggg
841 cagcggccta caacctggtc cagcacggca tcaccaacct gtgcgtcatc ggcggggatg
901 gcagcctcac aggtgccaac atcttccgca gcgagtgggg cagcctgctg gaggagctgg
961 tggcggaagg taagatctca gagactacag cccggaccta ctcgcacctg aacatcgcgg
1021 gcctagtggg ctccatcgat aacgacttct gcggcaccga catgaccatc ggcacggact
1081 cggccctcca ccgcatcatg gaggtcatcg atgccatcac caccactgcc cagagccacc
1141 agaggacctt cgtgctggaa gtgatgggcc ggcactgcgg gtacctggcg ctggtatctg
1201 cactggcctc aggggccgac tggctgttca tccccgaggc tccacccgag gacggctggg
1261 agaacttcat gtgtgagagg ctgggtgaga ctcggagccg tgggtcccga ctgaacatca
1321 tcatcatcgc tgagggtgcc attgaccgca acgggaagcc catctcgtcc agctacgtga
1381 aggacctggt ggttcagagg ctgggcttcg acacccgtgt aactgtgctg ggccacgtgc
1441 agcggggagg gacgccctct gccttcgacc ggatcctgag cagcaagatg ggcatggagg
1501 cggtgatggc gctgctggaa gccacgcctg acacgccggc ctgcgtggtc accctctcgg
1561 ggaaccagtc agtgcggctg cccctcatgg agtgcgtgca gatgaccaag gaagtgcaga
1621 aagccatgga tgacaagagg tttgacgagg ccacccagct ccgtggtggg agcttcgaga
1681 acaactggaa catttacaag ctcctcgccc accagaagcc ccccaaggag aagtctaact
1741 tctccctggc catcctgaat gtgggggccc cggcggctgg catgaatgcg gccgtgcgct
1801 cggcggtgcg gaccggcatc tcccatggac acacagtata cgtggtgcac gatggcttcg
1861 aaggcctagc caagggtcag gtgcaagaag taggctggca cgacgtggcc ggctggttgg
1921 ggcgtggtgg ctccatgctg gggaccaaga ggaccctgcc caagggccag ctggagtcca
1981 ttgtggagaa catccgcatc tatggtattc acgccctgct ggtggtcggt gggtttgagg
2041 cctatgaagg ggtgctgcag ctggtggagg ctcgcgggcg ctacgaggag ctctgcatcg
2101 tcatgtgtgt catcccagcc accatcagca acaacgtccc tggcaccgac ttcagcctgg
2161 gctccgacac tgctgtaaat gccgccatgg agagctgtga ccgcatcaaa cagtctgcct
2221 cggggaccaa gcgccgtgtg ttcatcgtgg agaccatggg gggttactgt ggctacctgg
2281 ccaccgtgac tggcattgct gtgggggccg acgccgccta cgtcttcgag gaccctttca
2341 acatccacga cttaaaggtc aacgtggagc acatgacgga gaagatgaag acagacattc
2401 agaggggcct ggtgctgcgg aacgagaagt gccatgacta ctacaccacg gagttcctgt
2461 acaacctgta ctcatcagag ggcaagggcg tcttcgactg caggaccaat gtcctgggcc
2521 acctgcagca gggtggcgct ccaacccccct ttgaccggaa ctatgggacc aagctggggg Fig. 33-2 – SEQ ID NO: 3269 PFKL 2581 tgaaggccat gctgtggttg tcggagaagc tgcgcgaggt ttaccgcaag ggacgggtgt
2641 tcgccaatgc cccagactcg gcctgcgtga tcggcctgaa gaagaaggcg gtggccttca
2701 gccccgtcac tgagctcaag aaagacactg atttcgagca ccgcatgcca cgggagcagt
2761 ggtggctgag cctgcggctc atgctgaaga tgctggcaca ataccgcatc agtatggccg
2821 cctacgtgtc aggggagctg gagcacgtga cccgccgcac cctgagcatg gacaagggct
2881 tctgaggcca gccatgccca cgcccctccc cagcccccac ccatgccagc gcagcgccag
2941 ggctcagatg gggcctgggc tgttgtgtct ggagcctgca ggcaggtggg ggctgcgtcc
3001 ctgctcagcc catcccctgc ctctatccct ggccacctgc caggcctccc tcgggctggt
3061 gtcttgagac cagcctgcca ggccctccag caggaggaca gagtgccctg gggcatccac
3121 cttcctgccc aggggacgtg gcgctgtcgg tgtttggagg ctgctgcccc ctggctttgg
3181 cgccccatgg gccctcagcg tctccccatg ctgggctcac tacatgggcc agcccttgct
3241 ctacctggcc ggtaggctgc tggcgcctag gttgtgttga gagggggatg cccctggccc
3301 tgcctcactg tgacctgctc ctgcccacgt gcagcacctg tcacctttc tagaaataaa
3361 atcaccctga ctgtggggtg catcggtctc cggagagcac a Fig. 34-1 – SEQ ID NO: 3270 SLC19A1

SLC19A1-Hs00953342_m1 NM_194255 4991BP

1 gctgtagtcc cggagtccgc gtgcgcgggg ccgggtccgg gagccccagg gcagccgccc
61 cgccgagtcg caggcacagc gtcaccttcg tcccctccgg agctgcacgt ggcctgagca
121 ggatggtgcc ctccagccca gcggtggaga agcaggtgcc cgtggaacct gggcctgacc
181 ccgagctccg gtcctggcgg cacctcgtgt gctacctttg cttctacggc ttcatggcgc
241 agatacggcc aggggagagc ttcatcaccc cctacctcct ggggcccgac aagaacttca
301 cgcgggagca ggtcacgaac gagatcacgc cggtgctgtc gtactcctac ctggccgtgc
361 tggtgcccgt gttcctgctc accgactacc tgcgctacac gccggtgctg ctgctgcagg
421 ggctcagctt cgtgtcggtg tggctgctgc tgctgctggg ccactcggtg gcgcacatgc
481 agctcatgga gctcttctac agcgtcacca tggccgcgcg catcgcctat tcctcctaca
541 tcttctctct cgtgcggccc gcgcgctacc agcgtgtggc cggctactcg cgcgctgcgg
601 tgctgctggg cgtgttcacc agctccgtgc tgggccagct gctggtcact gtgggccgag
661 tctccttctc cacgctcaac tacatctcgc tggccttcct caccttcagc gtggtcctcg
721 ccctcttcct gaagcgcccc aagcgcagcc tcttcttcaa ccgcgacgac cgggggcggt
781 gcgaaacctc ggcttcggag ctggagcgca tgaatcctgg cccaggcggg aagctgggac
841 acgccctgcg ggtggcctgt ggggactcag tgctggcgcg gatgctgcgg gagctggggg
901 acagcctgcg gcggccgcag ctgcgcctgt ggtccctctg gtgggtcttc aactcggccg
961 gctactacct ggtggtctac tacgtgcaca tcctgtggaa cgaggtggac cccaccacca
1021 acagtgcgcg ggtctacaac ggcgcggcag atgctgcctc cacgctgctg ggcgccatca
1081 cgtccttcgc cgcgggcttc gtgaagatcc gctgggcgcg ctggtccaag ctgctcatcg
1141 cgggcgtcac ggccacgcag gcggggctgg tcttccttct ggcgcacacg cgccacccga
1201 gcagcatctg gctgtgctat gcggccttcg tgctgttccg cggctcctac cagttcctcg
1261 tgcccatcgc cacctttcag attgcatctt ctctgtctaa agagctctgt gccctggtct
1321 tcggggtcaa cacgttcttt gccaccatcg tcaagaccat catcactttc attgtctcgg
1381 acgtgcgggg cctgggcctc ccggtccgca agcagttcca gttatactcc gtgtacttcc
1441 tgatcctgtc catcatctac ttcttggggg ccatgctgga tggcctgcgg cactgccagc
1501 ggggccacca cccgcggcag cccccggccc agggcctgag gagtgccgcg gaggagaagg
1561 cagcacaggc actgagcgtg caggacaagg gcctcggagg cctgcagcca gcccagagcc
1621 cgccgctttc cccagaagac agcctggggg ctgtggggcc agcctccctg gagcagagac
1681 agagcgaccc atacctggcc caggccccgg ccccgcaggc agctgaattc ctgagcccag
1741 tgacaacccc ttccccctgc actctgtgct ccgcccaagc ctcaggccct gaggctgcag
1801 atgagacttg tccccagctg gctgtccatc ctcctggtgt cagcaagctg ggtttgcagt
1861 gtcttccaag cgacggtgtt cagaatgtga accagtgact ctcgggcgcc cctgtggtaa
1921 ctttgcaggc ggccctcagt gcatccccac gacccctgcc tcgagggccg cctgccttag
1981 caatgggggc ctccgcttat cctgctagca ggccccctag gattccccct gccctgtgcc
2041 gcactctggc ggtggccaca gcgtgctggc gacactcagg gcagctgcct ggccatgctg
2101 tccctgcact gtgccccgcg ggctttgttg ctggaagagg tgggtggtgg gcttctgcgt
2161 ccaccaggcc tcactggctc atgccccttg gggggcttga gacaaatcct ttctgccccc
2221 cagggctagt gaagtggcct cttggatacc agctcagggg acactggccc cacaggagtt
2281 gtgagccctc tagggcaggg tgggagccgg gaccctcagg tgtagctgag ctgtgacatt
2341 gctggtcatc cttggtgctc ttgcttttttt gaaagatgct tttttttttt ttaactgacg
2401 tagaatgaag aactgcatgt ggcttctctg tctctgtgga aaagccatct caggttggcg
2461 gcagacacat tgtcatcaga ggggagcagc ggctctggtc ctcggagctg gttcctctct
2521 cccaccctaa gggcagccct ccatggtcct gtctgtcctt ctgaagtgtg tccatcctga Fig. 34-2 – SEQ ID NO: 3270 SLC19A1

2581 cctgcgggtc ctcagctgct cccacacttg tgccagcccg gaggggactg gtcccggtca
2641 ccgcggacgt gctggccttg gtatgtgcca ggcttgcctg ggctgggcag ccttgggggg
2701 gctgcctttg tggtgggcgc tggggaagta cgtcccagcg gcctcagggt ctaaggagcg
2761 ctagtgcctt gcccacaggt gcgggaccat ctgatgtgat gtgaatactc ttcccacata
2821 cattaaacac acttaagtga gtgtgcgcag ggcttctgat tcagggccgg cctggcctgg
2881 gggttgaggg tcagcagtca gtgaggaggc caggagaggc gtcccagcct tctcccgcct
2941 ccagcccacg cagggccttg gtgcccatga gctgagcacc cccacaaccc tagtcaacgg
3001 ccctatcctg tggggcctct gccacatctc agcggcccca ggtgaatggc tggctgctca
3061 gcacggagag ctggggagag aatctctggc tggggagggg ctgctggagc tgctggaccc
3121 aggggtctcc cgaggtggct caggggagca ggcatcttgg ggtaccctgg gttgaggcag
3181 aggctgcacg tggaagatgg cccgagtcag tggatggtgc cagtcagaca gggccatggt
3241 cccaggtgca tccaggggct ctgtcatggc caccctgggg accctgcttg gggggggtc
3301 tgcaccagcc atttcctggg ctcgtagatc tagcaggatg tgatgggtgg aggtgggctg
3361 ggcctgtgcc atgggctaga gcgtcactgg ggaggcccac accgccatca gaatcctcct
3421 cccagcgcct ccccaacctg agggcctgct ccctccgcag cctgctcact gcacccactg
3481 cctgcctgcc tctgagtcct gcactcaccc gtccaccagg acagggatgg ctgtcaggat
3541 gtagtgttgc tgggagcaag tcaggtcctg ctgtgaggag agacctaaga gtgttggtgt
3601 gtgtccacac acccgtgcat gcctgtgtac ctgtgcacac tatggatgct cctgcacacc
3661 tgtgtacaac tgcacgcctg tgtatggcca tgcatgcata ccccatgtaa ccgtgcgtgc
3721 ctgtgcacac tcgggatctg ccagtggggc agtccaggga taaaagactc ctgagaactc
3781 cttttggaga attgtgtcct tcctgtgaca gtgaaggctg cttgcaaacc aagagtcagt
3841 gtaaaaggtc acttttattt gcctgtctga attggcttca catcacacac aattacagaa
3901 ccagccccac cggtttcgtc gcagtcctga ggcaggtgcg tgttggctgt gctgtggtca
3961 gcctggcgct gccctgagtc cacttgtccc tccacagaac gaatgactcg ggttgatgtt
4021 gccggatctc aggggtggct gtgactgaca gaggaccttg ttgcacctcg tggctgcttt
4081 gttcacccgc agggcggcct gtgggcaccc cggggttccc cttcagtccc aaggagggta
4141 aggatatggg tttcctagga gacagccaat gactgccctg catctggagc cagcctgtcc
4201 atgggcagtg cacagatgac agccctccct cactgccctg tgtgctggct accgcatgtc
4261 ctgtgccagc ctcagcctct ttgatgtggc cgtgttccat cctggcgctc agctggacaa
4321 gtgctggctg agccacgtcc cagccagggg catgagatgg gggccctgga tgggaggctg
4381 ccagacccca actcatgggt cccttgaatc tcccagcttg gactcggcca gggtggagct
4441 gtctgctttg gatgtatcat ctcatggctc atttgggagg ccagccccag gctgctgtgc
4501 ttggtgttgg aggacaggcc ggagctgggg gtcacagtgc gcctctgagc ttgggaacct
4561 gcttcagcct ggggttgctg tggagaatgg cccagagctg agcagaaggg gctcccccta
4621 gccccaggga cctgagcctc cctcccatct accgcagggc gagcacacac cctggaggag
4681 cccagatggc cttgtgctga gtgtggcctc agctcccatt gcctcacggg gcctgtctgc
4741 taacaggtct gggttttgtg cacagaacgg tgctgctagg tgggagatga agtcagcacc
4801 tgctggggcg agcacggctt cccaaagcag gaaatcctgg agaaatcgag ccgtggtctg
4861 atcaggccaa gaggttgcac agggcatgat actgcaccct gcctgaccca gctgggctca
4921 caggtcaggg gagagttggg gcaggtgaat gtcagcatca ggcttctgtt ttaaactttt
4981 aaaaaaatac a Fig. 35-1 – SEQ ID NO: 3271 PRDM15

PRDM15-Hs00411318_m1 NM_022115 7512BP

1 ggtgctgcgc agtttccgga gcggatcgca acccggagtc cggatccgat cccgctctgc
61 acattccaaa ggcagccgcg cgccgccccg gtccagccgc catgccgact gttctttgtt
121 acattcgccg gctgcgggca ccgttggcga tcggagtcaa aacccggctg gatttcccgg
181 agccgctccg ggatcgccct gcgcgccgcc cgcccgccgg ggtcttcgcc gcccccggccc
241 gcggccccgc ggcccccgcc gccgggcggc gtcgtcgccg aggccccagg ggatgtcgtt
301 atcccccgcc ctcgggtaca gcccatgcgg gtcgcacggg ggggtccctg gaccccccaac
361 cccgcgttta gagaagctga gtcctggtcc cagattggga accagagggt cagtgagcag
421 ctcttggaaa catctctagg gaatgaggtg tccgacactg agccactgag ccctgcgagt
481 gcaggcctgc gacgcaatcc tgccctacct cctggaccct ttgcacaaaa cttttcctgg
541 gggaaccagg aaaatctgcc cccagccctg gggaagattg cgaacggagg aggaactggg
601 gcaggcaagg ccgaatgcgg ctatgaaact gagtcacact tgctagagcc gcacgagata
661 cctttgaacg tgaatacaca caagttcagt gactgtgagt ttccatatga gttttgcacg
721 gtctgctttt caccccttcaa gctgctgggg atgagcgggg tggagggcgt gtggaatcag
781 cattcaagaa gtgccagcat gcacactttc ctaaaccact cagcaacggg catcagagaa
841 gcaggttgca ggaaggacat gccggtgtca gagatggctg aagatgggag cgaagagatc
901 atgttcatct ggtgtgaaga ctgcagccag taccacgact ccgaatgtcc cgagctgggc
961 ccagtggtca tggtcaaaga ctcctttgtg ttaagcaggg caaggtcttg gcctgccagc
1021 ggacacgtgc acacccaggc ggggcagggg atgcggggtt atgaggacag ggacagggct
1081 gacccacagc agcttccaga agcagtccct gcaggcctgg tgaggcggct cagtgggcag
1141 cagctgccct gccgttccac cctcacctgg gggaggctgt gccacctggt ggcccagggc
1201 aggtcatccc ttcctcccaa cttggagatc agacgactgg aagatggagc cgaggggggtg
1261 ttcgccatca ctcagctcgt caagcggaca cagttcggtc cctttgagtc caggagggtc
1321 gccaaatggg aaaaggagtc tgcatttccc ctgaaggtgt tccagaagga cgggcacccc
1381 gtgtgcttcg acacctccaa cgaggatgac tgcaactgga tgatgctggt gcggccagcg
1441 gcggaggccg agcaccagaa cctgacggcc taccagcacg gcagcgacgt gtacttcacc
1501 acctccagag acatcccccc gggtaccgag ctgcgcgtgt ggtatgcggc cttctatgcc
1561 aagaagatgg acaagcccat gctgaagcag gccggctctg gcgtccacgc tgcaggcacc
1621 ccagaaaaca gcgcccccgt ggagtcggag cccagccagt gggcgtgtaa agtgtgttct
1681 gccaccttcc tggagctgca gctcctcaat gaacatctgt tgggccactt agaacaagcc
1741 aaaagccttc ctccaggcag ccaaagcgag gcagcagctc ccgagaagga gcaggacaca
1801 ccccgggggg aacccccctgc agtgcccgag agcgagaatg ttgccaccaa agaacagaag
1861 aaaaagcctc gaagggggag aaaacccaaa gtgtccaaag ctgagcagcc tctagtcatc
1921 gtggaagaca aggaacccac agagcaagtg gcagagatca ttaccgaggt ccctccggat
1981 gagcctgtga gtgcaacgcc agatgagcgg atcatggagc tggttctggg gaagctggcc
2041 accaccacca ctgacaccag ctcggttcca aagttcaccc atcatcagaa taacaccatc
2101 acgctcaaga ggagcttaat tctctcaagc agacacggca tccggcgcaa gctcatcaaa
2161 cagctcgggg agcacaagcg ggtttaccag tgcaatatct gcagcaagat cttccagaac
2221 agcagcaacc tgagcaggca cgtgcgctcg catggtgaca agctgtttaa gtgcgaagag
2281 tgtgcaaaat tgttcagccg caaagagagc ctaaagcagc acgtttccta caagcacagc
2341 aggaacgagg tggacggcga gtacaggtac cgctgcggca cttgtgagaa gaccttccgc
2401 atcgagagcg cgctggagtt ccacaactgc aggacagatg acaagacgtt ccaatgtgag
2461 atgtgtttca gattcttctc caccaacagc aacctctcca agcacaagaa gaagcacggc
2521 gacaagaagt ttgcctgtga ggtctgcagc aagatgttct accgcaagga cgtcatgctg Fig. 35-2 – SEQ ID NO: 3271 PRDM15

2581 gaccaccagc gccggcacct ggaaggagtg cggcgagtga agcgagagga cctggaggcc
2641 ggtggggaga acctggtccg ttacaagaag gagccttccg ggtgccccggt gtgtggcaag
2701 gtgttctcct gccggagcaa tatgaacaag cacctgctca cccacggcga caagaagtac
2761 acctgcgaga tctgcgggcg caagttcttc cgcgtggatg tgctcaggga ccacatccat
2821 gtccacttca aggacatcgc gttgatggat gaccaccaga gggaagagtt tatcggcaag
2881 atcgggatct cctcggaaga aaacgatgac aattctgacg agagcgcaga ctcggagcct
2941 cacaagtaca gctgcaagcg gtgccagctc accttcggcc gggggaagga gtacctgaag
3001 cacatcatgg aggtgcacaa ggagaagggc tatggctgca gcatctgcaa ccggcgcttt
3061 gcactgaagg ccacctacca cgcccacatg gtcatccacc gtgaaaacct gccggacccc
3121 aacgtgcaga agtacatcca cccctgcgag atctgcgggc ggatcttcaa cagcatcggg
3181 aacctggagc gccacaagct catccacaca ggtgtgaaga gccacgcctg cgagcagtgt
3241 gggaagtcct ttgccaggaa ggacatgctg aaggagcaca tgcgtgtgca cgacaatgtc
3301 cgcgagtacc tgtgtgccga gtgtgggaaa ggcatgaaga ccaagcacgc gctgcgccac
3361 cacatgaagc tgcacaaggg catcaaggag tacgagtgca aggagtgcca ccgcaggttc
3421 gcgcagaagg tcaacatgct caagcactgc aagcggcaca cggggattaa agatttcatg
3481 tgtgaattgt gtgggaagac attcagcgag aggaacacca tggagaccca caagctcatc
3541 cacacagtgg gcaagcagtg gacgtgctcc gtgtgcgaca agaagtacgt gaccgagtac
3601 atgctgcaga agcacgttca gctcacacac gacaaggtgg aggcgcagag ctgccagctg
3661 tgcgggacca aggtgtccac cagggcctcc atgagccgac acatgcggcg caagcacccc
3721 gaggtgctcg cggtgaggat cgatgacctg gaccacctcc cggagaccac caccatcgac
3781 gcctcctcca ttggcatcgt ccagcctgag ctgactctgg agcaggagga tttggccgaa
3841 gggaagcacg ggaaagctgc caagcgaagt cacaagagaa agcagaagcc agaagaggag
3901 gcgggtgctc cggtgcccga ggacgccacc ttcagcgaat actcagagaa agagacggag
3961 ttcacaggca gtgtaggcga cgagaccaat tccgcagtac agagcattca gcaggtagtg
4021 gtgaccctgg gtgacccaaa tgtgaccaca ccatcgagct cagtcggctt aaccaacatc
4081 accgtgaccc ccatcaccac tgcggccgcg actcagttta ccaatctcca gccggtggcc
4141 gtggggcacc ttaccacccc tgaacgccag ttacagctgg acaactcaat cctgaccgtg
4201 acctttgata ccgtcagcgg ctctgccatg ttgcacaacc gccaaaatga cgtccagatc
4261 cacccccagc cggaagcctc gaacccacag tctgtggccc atttcatcaa cctgacgacc
4321 ctggtcaact ccatcacgcc cctggggagc cagcttagtg accagcaccc gctcacgtgg
4381 cgggcagtgc cccagactga cgtcttgcca ccctcgcagc cgcaggcacc cccacagcag
4441 gcggcccagc cccaggtgca ggcggagcag cagcagcagc agatgtacag ctactgagct
4501 gcgttccggg agactcgggg caagaactgc agagggatgt ttgggatttg tttagatgtg
4561 tttgctggat accaaacaaa caaaaagtca tacattgcaa tgtaaggttg acttagcttt
4621 gcagagtatc tccagatccc ccgccagcaa ccattacggt ctgtcagctt aactctagaa
4681 gggacctctg gcaggccaga gttttaaact ggatggggct ccacaccatg ccttaccaag
4741 gcagtaagtc ctgggccggg gccgcatctg cctcccctta cagaaccagt gttcgcccga
4801 cacagggttc gggaaagtga agctgagaga gaagcaggat tttaagaggc aggagataag
4861 ttattaggaa cacaaatggt tcattttctt ttttctttta gagctcggtt cctatgagaa
4921 cacagacagt attcacaggt ggcagcaggc agcagggaac attttctcct cacttctgga
4981 tttttttgca agcgagcaca tagaagttaa agtaacgtgt attctctttg aactaggagt
5041 ggagtcggtt cttatacaac tatgggctga aaccatgagg cgtgctgagc cgcacctgat
5101 cctgcaacct tcgaggtcat cacggtcatc atgtgcaagg ggtcacgtga ggtcactgac
5161 tccagctcaa aacgcatctt agtaatatcc atgaatcgat ttccaataga gtttttttcc Fig. 35-3 – SEQ ID NO: 3271 PRDM15

5221 tttttttttt ttaactttat ttcaaacata cattatgtgt tcaagactgt tatggccaat
5281 attgtgtttt agttttatgt taacatgata aagtcatgtg cactgtagga ccatctgtcc
5341 ctgtccaccc ttcacagctg cccagatgca gagggtcgcg cggctgtgtg tgaggagtga
5401 gcctccctgc tgcccccagg ggctcctccg ggttgtctca ggattctctg caatccaaat
5461 gtatccattc tggctgaagc ccagccagaa tcccgagtgg aagaaacggg ggaaaagtca
5521 tattttcctt ctgtttaaac ttcaattcca aaggttggtg tatttcatga ccagttttct
5581 ataaaaatat tgaatgagtt tggctcttta caatggaaaa gtgtaggtat ttctgaaaca
5641 cagagaaaat gctatttcct gccaggtggt aatgaaagca gagaggttag ttcactaata
5701 gaagcattaa ttgcccctaa aactgaatgt gcggtgaaca gccaggtctg cgtgtgcggg
5761 gacacgtgct gtcacgtctg tgtaccagtt tcgggggcag gggccagggt tgggggaggc
5821 acccagccct cctgctgccc acgacaagaa acactgagag gtgtggggag aagtttgctc
5881 ttaactttcc tggtactctg tttgtggcca cagtgagagg acaaacctgc cttaaggtgt
5941 cctgctttgc cagttatccc agatcctgca ctcactggga gtccatcttg aggaaacact
6001 ggcatggctg agtaattgat caggagcagt cctgatgttg ccagcagaac aaaggatgat
6061 tgtgtttttc aaaacgcaac tttctcagca cttcactcca aacagcagac ttttgaggac
6121 agggctggaa tttgttttgt gcaatatatg ccttcatgaa ctaaggaatg ttcatcccca
6181 ggcagcatgc aggagggtct gtggggctca cctcctcacc ttacccacca tcactcgcgc
6241 ctagctctca cctctcagtt gaatgaatag tgggagatca tttgactttt aatttatgag
6301 aattatttta tgttatttat gtatataatt aactgtttta tacatagtag tctcatcaaa
6361 tgaattcggg cttggggtga tattgtctcc attctccaga tacaagtgct ccaggcatcc
6421 atggaatcag caggagacca gggctcctaa gatatatttt taaaaatcag tatcgatttc
6481 tttttgcctt tgcagaatct aaagggcaaa tgacctcgca gagactccca acgggctttg
6541 ggctcatgac gaaacaccca ctagcattga tcttttattc ctcttcccta taaaataaag
6601 gccttggaaa tcacaatttt atttttttaa agaagttgtt ttagtgccta gagtaagacc
6661 gcatcaaatg ttgttaaaga acctaattta gattgtgtgg tatataccac tgtttatctc
6721 aatacacaga cacctcttac ttcttgttat aagtgagaac tctaaagaaa aatcaaactc
6781 ccaagttttc tgtaaacata cgtggtctta atagggtcac tgtctgaggc aaaatgggtt
6841 gtcttaaagc aattgctaca aatttgcatc aaagaaacta gatagcaaaa tacaacaacc
6901 atgtaccacc caggcagaag agtcctcacc tatacgcagt tctgcatatt gatcatcatg
6961 acaggaagta tttcgttttt taactgatcc caggtgcaca gatgtattca taaaggaaga
7021 cattagatcc agccattgtg gccaccaggc tctgtggacc catctcagtg gagaattcgt
7081 tttggacccg tggctccgtg cagctgtgga ctcgagtgcc atccactggt gtgagtcttg
7141 cggggaggcc acaggtacag ctgctccccg tgaatcctgg tctgtgggtt gagaaggggc
7201 tcgggcctct ggaatgctct agcgtgtgac gtgttctcag gaaaacgttc tgtgccaagt
7261 gccgcctcgc tgtgtccggc atgggactgc gctggagggt ccggcgtgga aggcagacct
7321 cctgtacctc tatcgttccc atttgtggca tccaaaggcg gaaggctcat ggcttcccca
7381 ctagaggcgg cgtcttgggc tttcccattg gattgtgaaa ggcattaaga ctgtttggag
7441 atgttggctg tatttcctgt cacatcaggt tgtatgatga cgaataaaag gtgctgtgac
7501 ccgtgttttc aa Fig. 36-1 – SEQ ID NO: 3272 COL6A1

COL6A1-Hs01095585_m1 NM_001848 4203BP

1 agaaggcagc ctcggtctct gggcggcggc ggcggcccac tctgccctgg ccgcgctgtg
61 tggtgaccgc aggccccaga catgagggcg gcccgtgctc tgctgcccct gctgctgcag
121 gcctgctgga cagccgcgca ggatgagccg gagaccccga gggccgtggc cttccaggac
181 tgccccgtgg acctgttctt tgtgctggac acctctgaga gcgtggccct gaggctgaag
241 ccctacgggg ccctcgtgga caaagtcaag tccttcacca agcgcttcat cgacaacctg
301 agggacaggt actaccgctg tgaccgaaac ctggtgtgga acgcaggcgc gctgcactac
361 agtgacgagg tggagatcat ccaaggcctc acgcgcatgc ctggcggccg cgacgcactc
421 aaaagcagcg tggacgcggt caagtacttt gggaagggca cctacaccga ctgcgctatc
481 aagaaggggc tggagcagct cctcgtgggg ggctcccacc tgaaggagaa taagtacctg
541 attgtggtga ccgacgggca ccccctggag ggctacaagg aaccctgtgg ggggctggag
601 gatgctgtga acgaggccaa gcacctgggc gtcaaagtct tctcggtggc catcacaccc
661 gaccacctgg agccgcgtct gagcatcatc gccacggacc acacgtaccg gcgcaacttc
721 acggcggctg actgggccca gagccgcgac gcagaggagg ccatcagcca gaccatcgac
781 accatcgtgg acatgatcaa aaataacgtg gagcaagtgt gctgctcctt cgaatgccag
841 cctgcaagag gacctccggg gctccggggc gaccccggct ttgagggaga acgaggcaag
901 ccggggctcc caggagagaa gggagaagcc ggagatcctg gaagacccgg ggacctcgga
961 cctgttgggt accagggaat gaagggagaa aaagggagcc gtggggagaa gggctccagg
1021 ggacccaagg gctacaaggg agagaagggc aagcgtggca tcgacggggt ggacggcgtg
1081 aagggggaga tggggtaccc aggcctgcca ggctgcaagg gctcgcccgg gtttgacggc
1141 attcaaggac cccctggccc caagggagac cccggtgcct ttggactgaa aggagaaaag
1201 ggcgagcctg gagctgacgg ggaggcgggg agaccaggga gctcgggacc atctggagac
1261 gagggccagc cgggagagcc tgggcccccc ggagagaaag gagaggcggg cgacgagggg
1321 aacccaggac ctgacggtgc cccgggggag cggggtggcc ctggagagag aggaccacgg
1381 gggaccccag gcacgcgggg accaagagga gaccctggtg aagctggccc gcagggtgat
1441 cagggaagag aaggccccgt tggtgtccct ggagacccgg gcgaggctgg ccctatcgga
1501 cctaaaggct accgaggcga tgagggtccc ccagggtccg agggtgccag aggagcccca
1561 ggacctgccg gacccccctgg agacccgggg ctgatgggtg aaaggggaga agacggcccc
1621 gctggaaatg gcaccgaggg cttccccggc ttccccgggt atccgggcaa caggggcgct
1681 cccgggataa acggcacgaa gggctacccc ggcctcaagg gggacgaggg agaagccggg
1741 gaccccggag acgataacaa cgacattgca ccccgaggag tcaaaggagc aaaggggtac
1801 cggggtcccg agggccccca gggaccccca ggacaccaag gaccgcctgg gccggacgaa
1861 tgcgagattt tggacatcat catgaaaatg tgctcttgct gtgaatgcaa gtgcggcccc
1921 atcgacctcc tgttcgtgct ggacagctca gagagcattg gcctgcagaa cttcgagatt
1981 gccaaggact tcgtcgtcaa ggtcatcgac cggctgagcc gggacgagct ggtcaagttc
2041 gagccagggc agtcgtacgc gggtgtggtg cagtacagcc acagccagat gcaggagcac
2101 gtgagcctgc gcagccccag catccggaac gtgcaggagc tcaaggaagc catcaagagc
2161 ctgcagtgga tggcgggcgg caccttcacg ggggaggccc tgcagtacac gcgggaccag
2221 ctgctgccgc ccagcccgaa caaccgcatc gccctggtca tcactgacgg gcgctcagac
2281 actcagaggg acaccacacc gctcaacgtg ctctgcagcc ccggcatcca ggtggtctcc
2341 gtgggcatca aagacgtgtt tgacttcatc ccaggctcag accagctcaa tgtcatttct
2401 tgccaaggcc tggcaccatc ccagggccgg cccggcctct cgctggtcaa ggagaactat
2461 gcagagctgc tggaggatgc cttcctgaag aatgtcaccg cccagatctg catagacaag
2521 aagtgtccag attacacctg ccccatcacg ttctcctccc cggctgacat caccatcctg Fig. 36-2 – SEQ ID NO: 3272 COLGA1

2581 ctggacggct ccgccagcgt gggcagccac aactttgaca ccaccaagcg cttcgccaag
2641 cgcctggccg agcgcttcct cacagcgggc aggacggacc ccgcccacga cgtgcgggtg
2701 gcggtggtgc agtacagcgg cacgggccag cagcgcccag agcgggcgtc gctgcagttc
2761 ctgcagaact acacggccct ggccagtgcc gtcgatgcca tggactttat caacgacgcc
2821 accgacgtca acgatgccct gggctatgtg acccgcttct accgcgaggc ctcgtccggc
2881 gctgccaaga agaggctgct gctcttctca gatggcaact cgcagggcgc cacgcccgct
2941 gccatcgaga aggccgtgca ggaagcccag cgggcaggca tcgagatctt cgtggtggtc
3001 gtgggccgcc aggtgaatga gccccacatc cgcgtcctgg tcaccggcaa gacggccgag
3061 tacgacgtgg cctacggcga gagccacctg ttccgtgtcc ccagctacca ggccctgctc
3121 cgcggtgtct tccaccagac agtctccagg aaggtggcgc tgggctagcc caccctgcac
3181 gccggcacca aaccctgtcc tcccacccct ccccactcat cactaaacag agtaaaatgt
3241 gatgcgaatt ttcccgacca acctgattcg ctagattttt tttaaggaaa agcttggaaa
3301 gccaggacac aacgctgctg cctgctttgt gcagggtcct ccggggctca gccctgagtt
3361 ggcatcacct gcgcagggcc ctctggggct cagccctgag ctagtgtcac ctgcacaggg
3421 ccctctgagg ctcagccctg agctggcgtc acctgtgcag ggccctctgg ggctcagccc
3481 tgagctggcc tcacctgggt tccccacccc gggctctcct gccctgccct cctgcccgcc
3541 ctccctcctg cctgcgcagc tccttcccta ggcacctctg tgctgcatcc caccagcctg
3601 agcaagacgc cctctcgggg cctgtgccgc actagcctcc ctctcctctg tccccatagc
3661 tggtttttcc caccaatcct cacctaacag ttactttaca attaaactca aagcaagctc
3721 ttctcctcag cttggggcag ccattggcct ctgtctcgtt ttgggaaacc aaggtcagga
3781 ggccgttgca gacataaatc tcggcgactc ggccccgtct cctgagggtc ctgctggtga
3841 ccggcctgga ccttggccct acagccctgg aggccgctgc tgaccagcac tgaccccgac
3901 ctcagagagt actcgcaggg gcgctggctg cactcaagac cctcgagatt aacggtgcta
3961 accccgtctg ctcctccctc ccgcagagac tggggcctgg actggacatg agagcccctt
4021 ggtgccacag agggctgtgt cttactagaa acaacgcaaa cctctccttc ctcagaatag
4081 tgatgtgttc gacgttttat caaaggcccc ctttctatgt tcatgttagt tttgctcctt
4141 ctgtgttttt ttctgaacca tatccatgtt gctgactttt ccaaataaag gttttcactc
4201 ctc Fig. 37-1 – SEQ ID NO: 3273 ABCG1

ABCG1-Hs01555191_m1 NM_016818 2976BP

1 ggagcccaag cgcagcccgc accccgcgca gcggctgagc cgggagccag cgcagcctcg
61 gccccgcagc tcaagcctcg tccccgccgc cgccgccgcc gccgccgccg ccgcccccgg
121 ggcatggcct gtctgatggc cgctttctcg gtcggcaccg ccatgaatgc cagcagttac
181 tctgcagaga tgacggagcc caagtcggtg tgtgtctcgg tggatgaggt ggtgtccagc
241 aacatggagg ccactgagac ggacctgctg aatggacatc tgaaaaaagt agataataac
301 ctcacggaag cccagcgctt ctcctccttg cctcggaggg cagctgtgaa cattgaattc
361 agggaccttt cctattcggt tcctgaagga ccctggtgga ggaagaaagg atacaagacc
421 ctcctgaaag gaatttccgg gaagttcaat agtggtgagt tggtggccat tatgggtcct
481 tccggggccg ggaagtccac gctgatgaac atcctggctg gatacaggga gacgggcatg
541 aagggggccg tcctcatcaa cggcctgccc cgggacctgc gctgcttccg gaaggtgtcc
601 tgctacatca tgcaggatga catgctgctg ccgcatctca ctgtgcagga ggccatgatg
661 gtgtcggcac atctgaagct tcaggagaag gatgaaggca gaagggaaat ggtcaaggag
721 atactgacag cgctgggctt gctgtcttgc gccaacacgc ggaccgggag cctgtcaggt
781 ggtcagcgca agcgcctggc catcgcgctg gagctggtga acaaccctcc agtcatgttc
841 ttcgatgagc ccaccagcgg cctggacagc gcctcctgct tccaggtggt ctcgctgatg
901 aaagggctcg ctcaaggggg tcgctccatc atttgcacca tccaccagcc cagcgccaaa
961 ctcttcgagc tgttcgacca gctttacgtc ctgagtcaag gacaatgtgt gtaccgggga
1021 aaagtctgca atcttgtgcc atatttgagg gatttgggtc tgaactgccc aacctaccac
1081 aacccagcag attttgtcat ggaggttgca tccggcgagt acggtgatca gaacagtcgg
1141 ctggtgagag cggttcggga gggcatgtgt gactcagacc acaagagaga cctcgggggt
1201 gatgccgagg tgaacccttt tctttggcac cggccctctg aagaggactc ctcgtccatg
1261 gaaggctgcc acagcttctc tgccagctgc ctcacgcagt tctgcatcct cttcaagagg
1321 accttcctca gcatcatgag ggactcggtc ctgacacacc tgcgcatcac ctcgcacatt
1381 gggatcggcc tcctcattgg cctgctgtac ttggggatcg ggaacgaagc caagaaggtc
1441 ttgagcaact ccggcttcct cttcttctcc atgctgttcc tcatgttcgc ggccctcatg
1501 cctactgttc tgacatttcc cctggagatg ggagtctttc ttcgggaaca cctgaactac
1561 tggtacagcc tgaaggccta ctacctggcc aagaccatgg cagacgtgcc ctttcagatc
1621 atgttcccag tggcctactg cagcatcgtg tactggatga cgtcgcagcc gtccgacgcc
1681 gtgcgctttg tgctgtttgc cgcgctgggc accatgacct ccctggtggc acagtccctg
1741 ggcctgctga tcggagccgc ctccacgtcc ctgcaggtgg ccactttcgt gggcccagtg
1801 acagccatcc cggtgctcct gttctcgggg ttcttcgtca gcttcgacac catccccacg
1861 tacctacagt ggatgtccta catctcctat gtcaggtatg ggttcgaagg ggtcatcctc
1921 tccatctatg gcttagaccg ggaagatctg cactgtgaca tcgacgagac gtgccacttc
1981 cagaagtcgg aggccatcct gcgggagctg gacgtggaaa atgccaagct gtacctggac
2041 ttcatcgtac tcgggatttt cttcatctcc ctccgcctca ttgcctattt tgtcctcagg
2101 tacaaaatcc gggcagagag gtaaaacacc tgaatgccag gaaacaggaa gattagacac
2161 tgtggccgag ggcacgtcta gaatcgagga ggcaagcctg tgcccgaccg acgacacaga
2221 gactcttctg atccaacccc tagaaccgcg ttgggtttgt gggtgtctcg tgctcagcca
2281 ctctgcccag ctgggttgga tcttctctcc attccccttt ctagctttaa ctaggaagat
2341 gtaggcagat tggtggtttt tttttttta acatacagaa ttttaaatac cacaactggg
2401 gcagaattta aagctgcaac acagctggtg atgagaggct tcctcagtcc agtcgctcct
2461 tagcaccagg caccgtgggt cctggatggg gaactgcaag cagcctctca gctgatggct
2521 gcacagtcag atgtctggtg gcagagagtc cgagcatgga gcgattccat tttatgactg Fig. 37-2 – SEQ ID NO: 3273 ABCG1

2581 ttgtttttca cattttcatc tttctaaggt gtgtctcttt tccaatgaga agtcattttt
2641 gcaagccaaa agtcgatcaa tcgcattcat tttaagaaat tatacctttt tagtacttgc
2701 tgaagaatga ttcagggtaa atcacatact ttgtttagag aggcgagggg tttaaccgag
2761 tcacccagct ggtctcatac atagacagca cttgtgaagg attgaatgca ggttccaggt
2821 ggagggaaga cgtggacacc atctccactg agccatgcag acatttttaa aagctataca
2881 aaaaattgtg agaagacatt ggccaactct ttcaaagtct ttctttttcc acgtgcttct
2941 tattttaagc gaaatatatt gtttgtttct tcctaa

COMBINATIONS OF BIOMARKERS FOR METHODS FOR DETECTING TRISOMY 21

CROSS-REFERENCE TO RELATED APPLICATIONS

This application is a continuation-in-part of U.S. application Ser. No. 14/361,895 filed May 30, 2014, which is the § 371 U.S. National Stage of International Application No. PCT/US2012/067328, filed Nov. 30, 2012, which claims the benefit of U.S. Provisional Application No. 61/565,761, filed Dec. 1, 2011, wherein each are incorporated by reference herein in their entireties.

SEQUENCE LISTING

This application contains a Sequence Listing which has been submitted in ASCII format via EFS-Web and is hereby incorporated by reference in its entirety. The ASCII copy, created on Mar. 10, 2021, is named W2460_10002US03_SL.txt and is 926,589 bytes in size.

BACKGROUND

Trisomy 21, also referred to as Down Syndrome and Mongolism, is the result of a chromosomal abnormality. A human cell has two types of chromosomes. One type is the autosomal chromosomes (chromosomes 1-22), and the other type is the sex chromosome (the X and Y chromosomes). In a normal human cell there are 46 chromosomes, and they are present in the cell as 23 pairs. Thus each normal human cell has two of each autosomal chromosomes (two copies of chromosome 1, two copies of chromosome 2, etc.) and one pair of sex chromosomes (an X and a Y chromosome for a male, or two X chromosomes for a female). A karyotype of a normal male is referred to as 46XY, and that of a normal female is 46XX. The chromosomal abnormality in a person having trisomy 21 is an extra chromosome 21. The karyotype of a male having trisomy 21 is 47XY+21, and the karyotype of a female having trisomy 21 is 47XX+21.

Trisomy 21 is typically caused by a meiotic nondisjunction event. With nondisjunction, a gamete (either a sperm or egg cell) is produced with an extra copy of the chromosome 21; thus, the gamete has 24 and not the normal 23 chromosomes. When combined with a normal gamete from the other parent, the resulting embryo has 47 chromosomes, with three copies of chromosome 21. An analogous process accounts for most cases of trisomy 13 and 18. Trisomy 21 is the cause of approximately 95% of Down syndromes, with 88% resulting from nondisjunction in the maternal gamete and 8% from nondisjunction in the paternal gamete. The actual Down syndrome "critical region" encompasses chromosome bands 21q22.1-q22.3.

Since trisomy 21 is usually caused by nondisjunction in the gametes prior to conception, all cells in the resulting conceptus are affected. However, when some of the cells in the body are normal and other cells have trisomy 21, it is called mosaic Down syndrome (46,XX/47,XX,+21). This can occur in one of main two ways: in the first, a nondisjunctional event occurs in a normal embryo during an early cell division results in a fraction of the cells having trisomy 21; in the second, a Down syndrome embryo secondary to nondisjunction loses the extra 21 chromosome with the result of a normal cell line. There is considerable variability in the fraction of trisomy 21 cells among mosaic trisomy 21, both as a whole and among tissues. Mosaicism causes 1-2% of Down syndrome.

Down syndrome is a random event. There is no evidence that it is due to parental behavior (other than age) or environmental factors. In 2006, the Centers for Disease Control and Prevention estimated the overall rate for Down syndrome in the United States was one per 733 live births (5429 new cases per year). Approximately 95% of these are trisomy 21. Down syndrome occurs in all ethnic groups and among all economic classes.

Maternal age affects the probability of conceiving a fetus with Down syndrome. At maternal age 20 to 24, the probability is one in 1562; at age 35 to 39 the probability is one in 214, and above age 45 the probability is one in 19 (Huether et al., 1998, J Med Genet 35 (6): 482-90. doi: 10.1136/jmg.35.6.482. PMID 9643290). Although the probability increases with advancing maternal age, 80% of children with Down syndrome are born to women under the age of 35, reflecting the overall fecundity of that age group. Recent information suggests paternal age, especially beyond 42 years increases the risk of Down syndrome too.

A diagnostic test for Down syndrome is typically preceded by some form of screening test (history, ultrasound or blood protein measurement) as the current methods for the definitive diagnosis involves an invasive test-amniocentesis, chorionic villus sampling or percutaneous umbilical cord blood sampling (PUBS)—that is then offered to families who are screen positive, i.e. have an increased likelihood of having a fetus with Down syndrome. In the United States, the American College of Obstetrics and Gynecology guidelines recommend non-invasive screening and invasive testing be offered to all women, regardless of their age, and most likely all physicians follow these guidelines. This recommendation is supported by some insurance plans that only reimburse invasive testing if the woman is >34 years old or if she has received a high-risk score from a non-invasive screening test. Amniocentesis, CVS and PUBS are invasive procedures that involve inserting instruments into the uterus, and therefore carry a risk of causing fetal injury or pregnancy loss. The risks of a loss from CVS and amniocentesis are often quoted as 1% and 0.5% respectively. In all likelihood, the fetuses lost as a result are otherwise normal.

In the past, several common non-invasive screening tests were the main method to identify a fetus at high risk for Down syndrome. These tests are typically performed in the late $1^{st}$ or early $2^{nd}$ trimester. Due to the nature of screening, each test has a significant chance of a false positive that is suggesting the fetus has Down syndrome when in fact, the fetus does not. Screen positive tests must be verified by an invasive procedure before a diagnosis of Down syndrome is made. More recently, these tests have been supplanted by a noninvasive screening method based on testing the fetal DNA in maternal blood often referred to as NIPS-noninvasive prenatal screening using plasma cell free DNA. Using one of several methods, the fetal DNA is isolated and probed to determine the presence of T21, T13, and T18 along with the Y chromosome. Common screening procedures for Down syndrome are given in Table A.

TABLE A

| First and Second trimester Down syndrome screens | | | | |
|---|---|---|---|---|
| Screen | Weeks gestation performed | Detection rate | False positive rate | Description |
| Quad screen | 15-20 | 81% | 5% | Measures the maternal serum a feto protein, estriol, human chorionic gonadotropin (hCG) and inhibin-α. |
| Nuchal translucency/free β/PAPP-A (1st Trimester Combined Test) | 10-13.5 | 85% | 5% | Uses ultrasound to measure Nuchal Translucency (NT) plus free β hCG and PAPP-A. |
| Integrated Test | 10-13.5 and 15-20 | 95% | 5% | The Integrated test uses both the 1st Trimester Combined test and the 2nd Trimester Quad test to yield a more accurate screening result. |
| NIPS | 9-40 | 99% | ≤1% | Fetal DNA derived from a maternal plasma sample |

Inaccuracies may result from undetected multiple fetuses (rare with adequate ultrasound testing), incorrect dating of the pregnancy, normal variation in the ultrasound measurements or maternal protein levels that constitute the screen, or operator error. These ultrasound measurements and protein levels overlap in the healthy and disease groups broadly in all instances.

Confirmation of screen positive status requires a fetal karyotype that should be accomplished by amniocentesis or chorionic villus sampling (CVS). Amniocentesis involves taking amniotic fluid from the amniotic sac, and CVS a placental biopsy, each to obtain fetal cells. The laboratory work can take several weeks but will detect over 99.8% of all numerical chromosomal problems with a very low false positive rate; however, these methods of confirmation have the risk of miscarriage of a healthy fetus. As a result, many patients chose to rely on the NIPS result in light of its high detection rate and low false positive rate and avoid the risk of a pregnancy loss from an invasive procedure.

As noted, the focus of noninvasive detection of Down syndrome has been on the separation and testing of fetal DNA found in the mother's peripheral blood. A few investigators have tried to use ribonucleic acid (RNA) based technologies with little applicable success. RNA is present in all living cells and is a reflection of how cell DNA is being used. Its many roles include acting as a messenger carrying instructions from DNA for controlling the synthesis of proteins, or to modify the transcribing of DNA or the translation of some RNAs.

SUMMARY OF THE INVENTION

In some embodiments, a method can include: obtaining a plasma sample from a human subject, wherein the human subject is a pregnant female; obtaining cell free nucleic acids from the plasma sample; detecting in the cell free nucleic acids the presence of a combination of nucleic acid biomarkers comprising: ATP5O, ICOSLG, DOP1B, PKNOX1, COL6A1, and GART, wherein the detecting comprises: contacting the cell free nucleic acids with primers or probes that are complementary to the nucleic acid biomarkers in the combination of nucleic acid biomarkers, and detecting hybridization between the primers or probes and the combination of nucleic acid biomarkers. In some aspects, the combination of nucleic acid biomarkers further comprises: ENSG00000199633 F2, hsa-mir-548I, hsa-mir-26b, hsa-mir-450b and ENSG00000212363.

In some embodiments, a method can include: obtaining a plasma sample from a human subject, wherein the human subject is a pregnant female; obtaining cell free nucleic acids from the plasma sample; detecting in the cell free nucleic acids the presence of a combination of nucleic acid biomarkers comprising: ENSG00000199633 F2, hsa-mir-548I, hsa-mir-26b, hsa-mir-450b, ENSG00000212363, and GART, wherein the detecting comprises: contacting the cell free nucleic acids with primers or probes that are complementary to the nucleic acid biomarkers in the combination of nucleic acid biomarkers, and detecting hybridization between the primers or probes and the combination of nucleic acid biomarkers. In some aspects, the combination of nucleic acid biomarkers further comprises: ATP5O, ICOSLG, DOPIB, PKNOX1, and COL6A1.

In some embodiments, the combination of nucleic acid biomarkers further comprises: RASGRP4, FAM20A, NEK9, ABCC1, SORBS2; TMPRSS2, DSCAM, ERG, ICOSLG, C21orf33, ADAMTS5, CXADR, NCAM2, UBASH3A, PFKL, CHODL, CYYR1, SLC19A1, PRDM15; COL6A1; and ABCG1.

In some embodiments, the combination of nucleic acid biomarkers further comprises: ENSG00000199633 F2, ENSG00000207147 F2, hsa-let-7d F1, hsa-mir-569 F1, hsa-mir-548I, ENSG00000201980, ENSG00000202231, hsa-mir-216b, hsa-mir-98, hsa-mir-26b, hsa-mir-581 F1, hsa-mir-450b, ENSG00000212363, ENSG00000199282, hsa-mir-523, hsa-mir-376a-2/1 F2, ENSG00000199856 F1, and HBII-276 F2.

In some embodiments, the nucleic acid biomarkers are RNA.

In some embodiments, the methods include detecting in the cell free nucleic acids the presence of a normalization nucleic acid.

In some embodiments, the method includes: obtaining a plasma sample from a second human subject, wherein the second human subject is a pregnant female carrying a fetus without trisomy 21; obtaining a second cell free nucleic acid sample from the plasma sample; and detecting in the second cell free nucleic acid sample the presence of the combination of nucleic acid biomarkers. In some aspects, the method can include: quantitating the amount of each nucleic acid biomarker in the cell free nucleic acids from the pregnant female; and quantitating the amount of each nucleic acid biomarker in the second cell free nucleic acid sample from the second pregnant female.

The above summary of the present invention is not intended to describe each disclosed embodiment or every implementation of the present invention. The description that follows more particularly exemplifies illustrative embodiments. In several places throughout the application, guidance is provided through lists of examples, which examples can be used in various combinations. In each instance, the recited list serves only as a representative group and should not be interpreted as an exclusive list.

BRIEF DESCRIPTION OF THE FIGURES

FIG. 1. Examples of normalization sequences. Peptidyl-prolyl isomerase A (SEQ ID NO:1); snRNA:U6:96Aa (SEQ ID NO: 2); snRNA:U6:96Ab (SEQ ID NO: 3); and snRNA: U6:96Ac (SEQ ID NO: 4).

FIGS. 2A-1 to 2A-72 and 2B-1 to 2B-2. Examples of T21 Biomarkers Selection: There are 3,143 mRNA biomarkers (FIGS. 2A-1 to 2A-72) and 98 noncoding small RNA sequences (miRNA plus other small RNAs such as snoRNA) biomarkers (FIGS. 2B-1 to 2B-2) selected from around 25,000 genes using Affymetrix microarray technique. FIGS. 2A-1 to 2A-72 and 2B-1 to 2B-2 are collectively referred to as FIG. 2 herein, where FIGS. 2A-1 to 2A-72 are collectively referred to as FIG. 2A and FIGS. 2B-1 to 2B-2 are collectively referred to as FIG. 2B.

FIGS. 3-1 to 3-255. Examples of 3,143 T21 mRNA biomarker sequences. Each biomarker includes the following: SEQ ID NO, Chromosome location, Gene Symbol, Gene Accession Number, fold-change, and sequence. FIGS. 3-1 to 3-255 are collectively referred to as FIG. 3.

FIGS. 4-1 to 4-7. Examples of 98 T21 noncoding small RNA biomarker sequences (miRNA plus other small RNAs such as snoRNA). Each biomarker includes the following: SEQ ID NO, Chromosome location, Gene Symbol, Gene Accession Number, fold-change, and sequence. FIGS. 4-1 to 4-7 are collectively referred to as FIG. 4.

FIGS. 5A-50. Examples of 15 T21 mRNA biomarkers confirmed by Real-time PCR in 10 affected pregnancies. The X-axis is the subject number. The figures represent a graphic illustration of marker expression in trisomy 21 (the squares) compared to the normal range for chromosomally normal fetuses. The dotted lines demarcate the 95% confidence interval for normal. FIGS. 5A-50 are collectively referred to as FIG. 5.

FIG. 6 shows that the maternal age in Normal (euploid fetus) women and those with a Trisomy 21 fetus.

FIG. 9 shows a comparison of 11 Machine Learning (ML) algorithms.

FIG. 10 shows general workflow that leads to the identification of the biomarker subsets that are described herein.

FIG. 11 shows data for the three best performing ML algorithms.

FIG. 13 shows the sequence for the mRNA of ATP50 (SEQ ID NO: 3249).

FIGS. 14-1 to 14-4 shows the sequence for the mRNA of DOPIB (SEQ ID NO: 3250).

FIGS. 15-1 to 15-5 shows the sequence for the mRNA of NCAM2 (SEQ ID NO: 3251).

FIG. 16 shows the sequence for the mRNA of UBASH3A (SEQ ID NO: 3252).

FIG. 17 shows the sequence for the mRNA of CHODL (SEQ ID NO: 3253).

FIGS. 18-1 to 18-2 shows the sequence for the mRNA of PKNOX1 (SEQ ID NO: 3254).

FIGS. 19-1 to 19-2 shows the sequence for the mRNA of CYYR1 (SEQ ID NO: 3255).

FIGS. 20-1 to 20-2 shows the sequence for the mRNA of GART (SEQ ID NO: 3256).

FIGS. 21-1 to 21-2 shows the sequence for the mRNA of RASGRP4 (SEQ ID NO: 3257).

FIGS. 22-1 to 22-2 shows the sequence for the mRNA of FAM20A (SEQ ID NO: 3258).

FIGS. 23-1 to 23-4 shows the sequence for the mRNA of NEK9 (SEQ ID NO: 3259).

FIGS. 24-1 to 24-3 shows the sequence for the mRNA of ABCC1 (SEQ ID NO: 3260).

FIGS. 25-1 to 25-2 shows the sequence for the mRNA of SORBS2 (SEQ ID NO: 3261).

FIG. 26 shows the sequence for the mRNA of TMPRSS2 (SEQ ID NO: 3262).

FIGS. 27-1 to 27-3 shows the sequence for the mRNA of DSCAM (SEQ ID NO: 3263).

FIGS. 28-1 to 28-2 shows the sequence for the mRNA of ERG (SEQ ID NO: 3264).

FIGS. 29-1 to 29-3 shows the sequence for the mRNA of ICOSLG (SEQ ID NO: 3265).

FIG. 30 shows the sequence for the mRNA of C21orf33 (SEQ ID NO: 3266).

FIGS. 31-1 to 31-5 shows the sequence for the mRNA of ADAMTS5 (SEQ ID NO: 3267).

FIGS. 32-1 to 32-3 shows the sequence for the mRNA of CXADR (SEQ ID NO: 3268).

FIGS. 33-1 to 33-2 shows the sequence for the mRNA of PFKL (SEQ ID NO: 3269).

FIGS. 34-1 to 34-2 shows the sequence for the mRNA of SLC19A1 (SEQ ID NO: 3270).

FIGS. 35-1 to 35-3 shows the sequence for the mRNA of PRDM15 (SEQ ID NO: 3271).

FIGS. 36-1 to 36-2 shows the sequence for the mRNA of COL6A1 (SEQ ID NO: 3272).

FIGS. 37-1 to 37-2 shows the sequence for the mRNA of ABCG1 (SEQ ID NO: 3273).

DETAILED DESCRIPTION OF ILLUSTRATIVE EMBODIMENTS

Figure 5A:
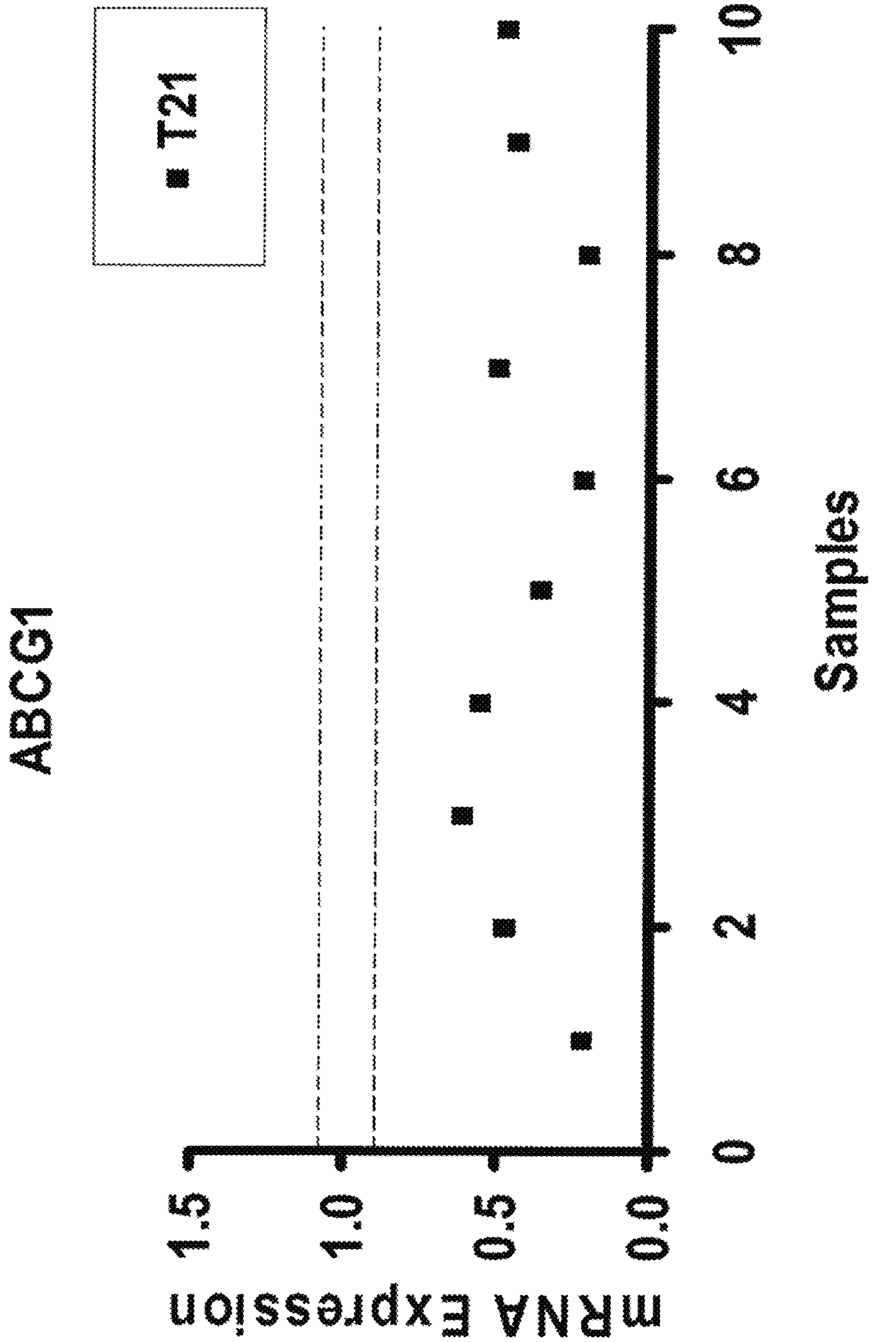
Figure 5B:
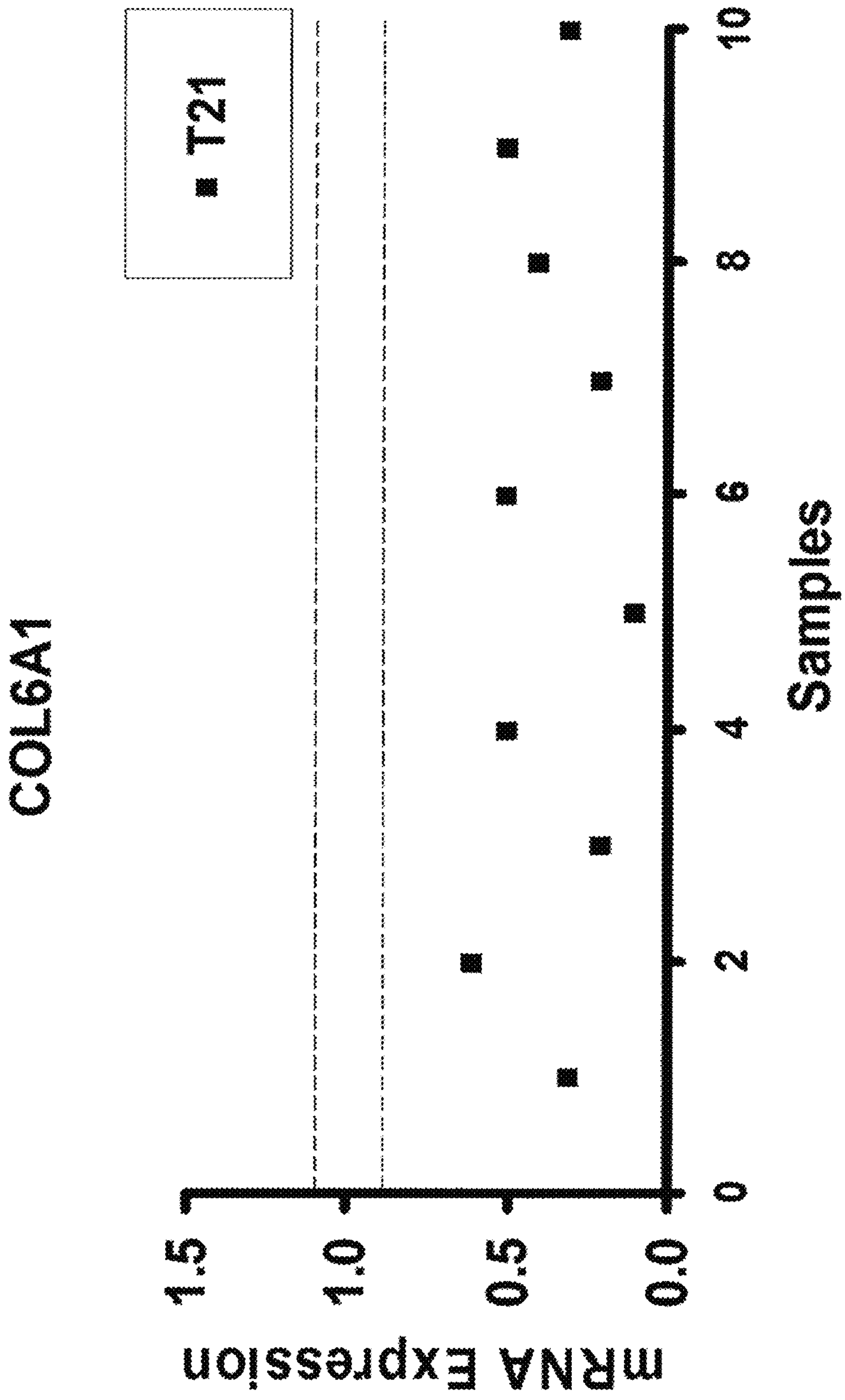
Figure 5C:
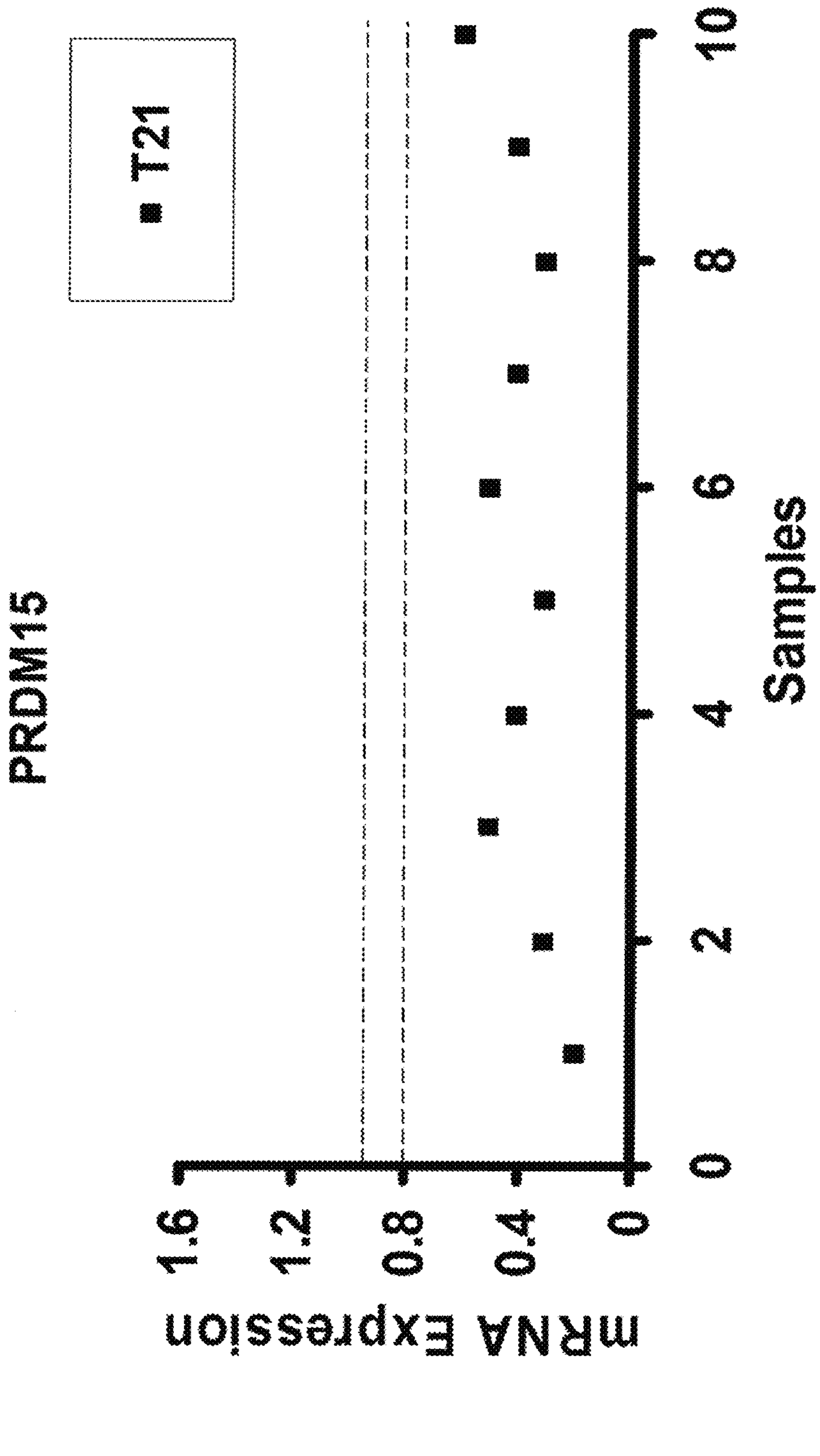
Figure 5D:
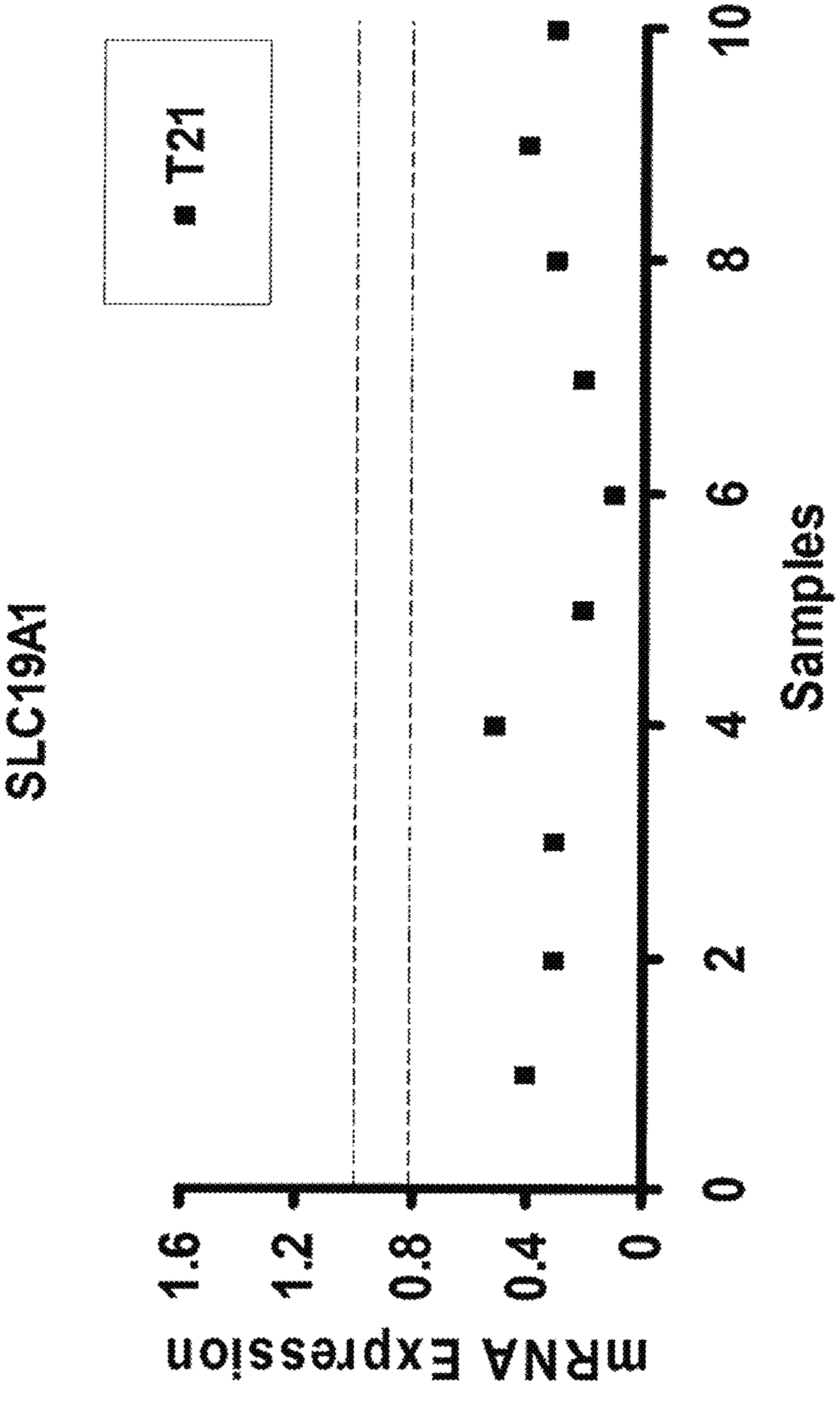
Figure 5E:
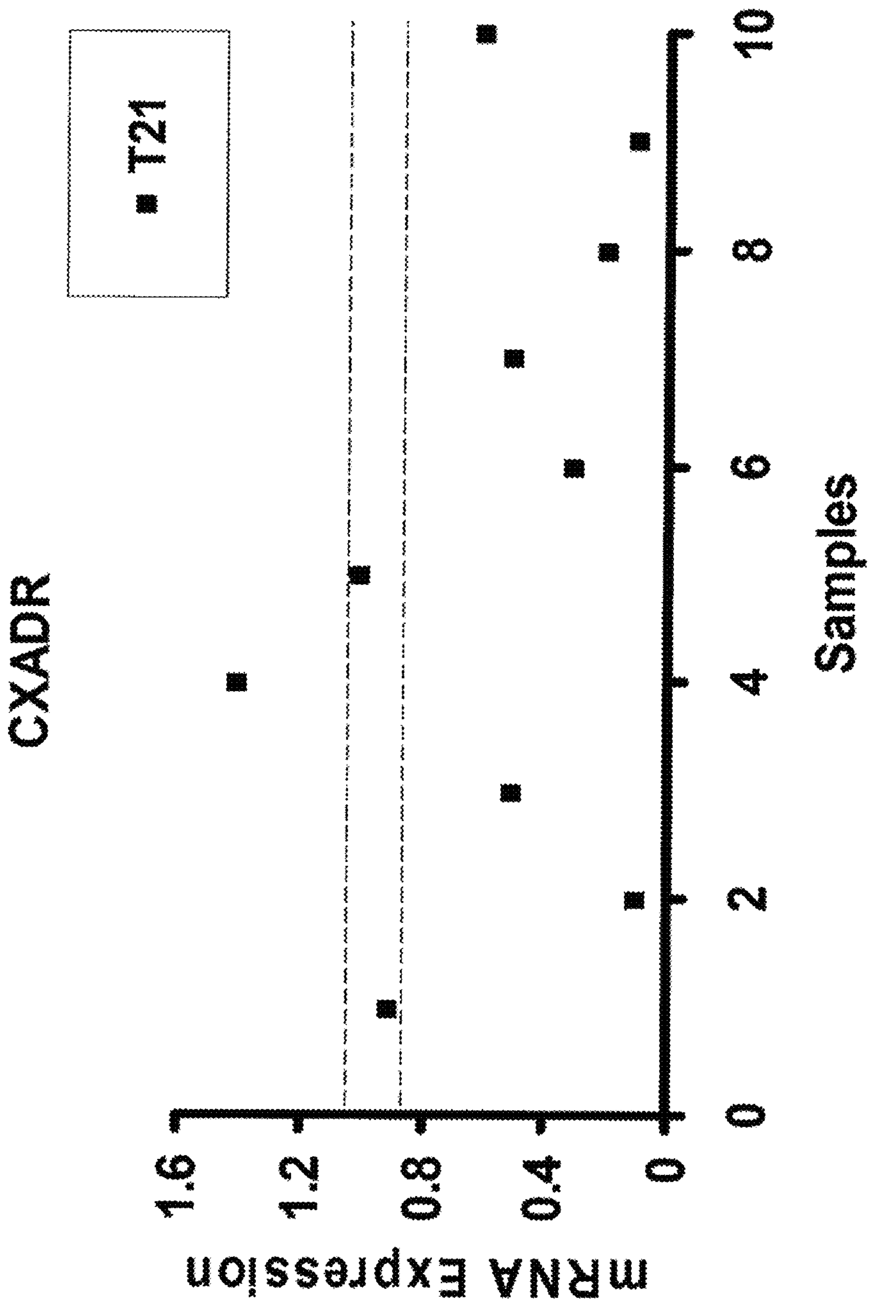
Figure 5F:
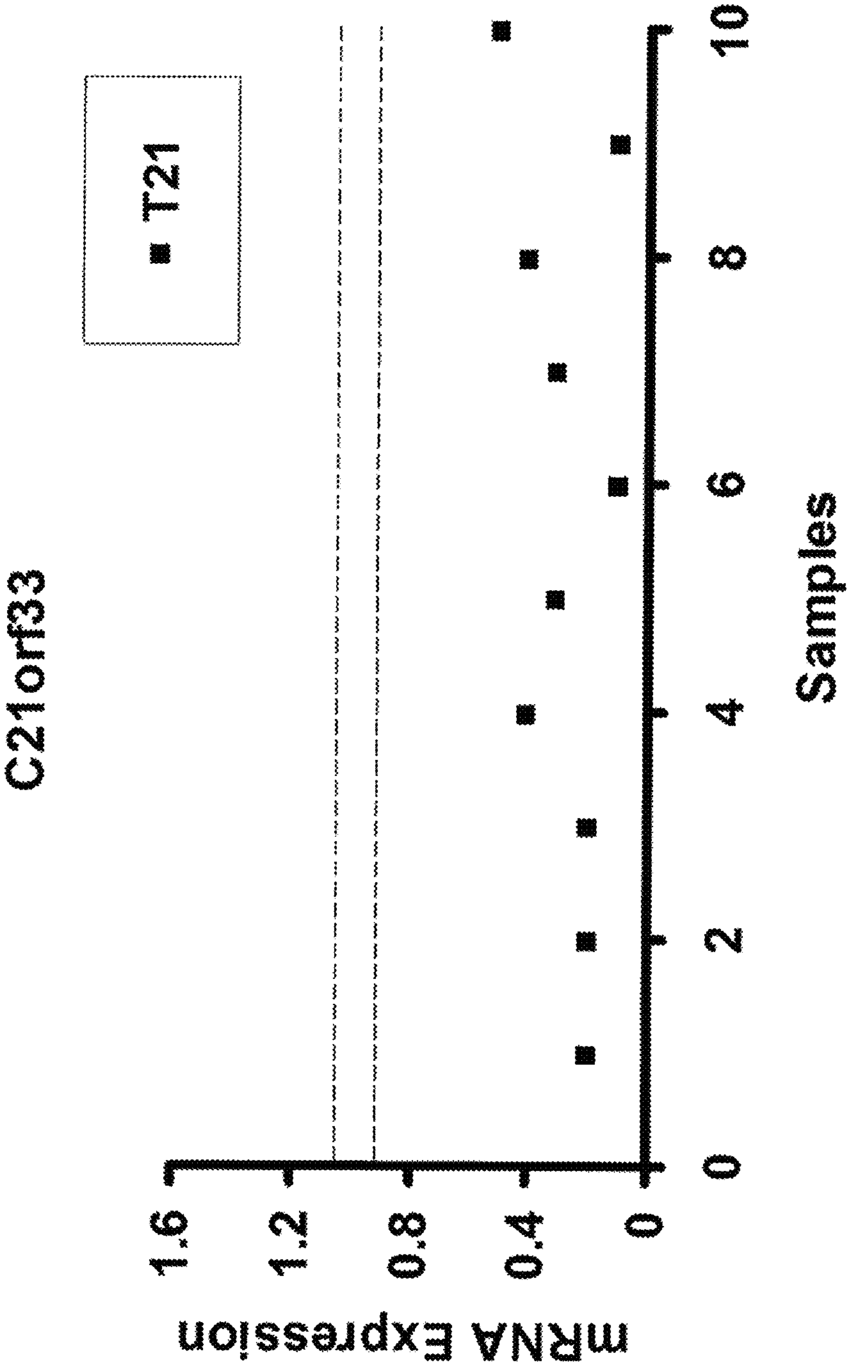
Figure 5G:
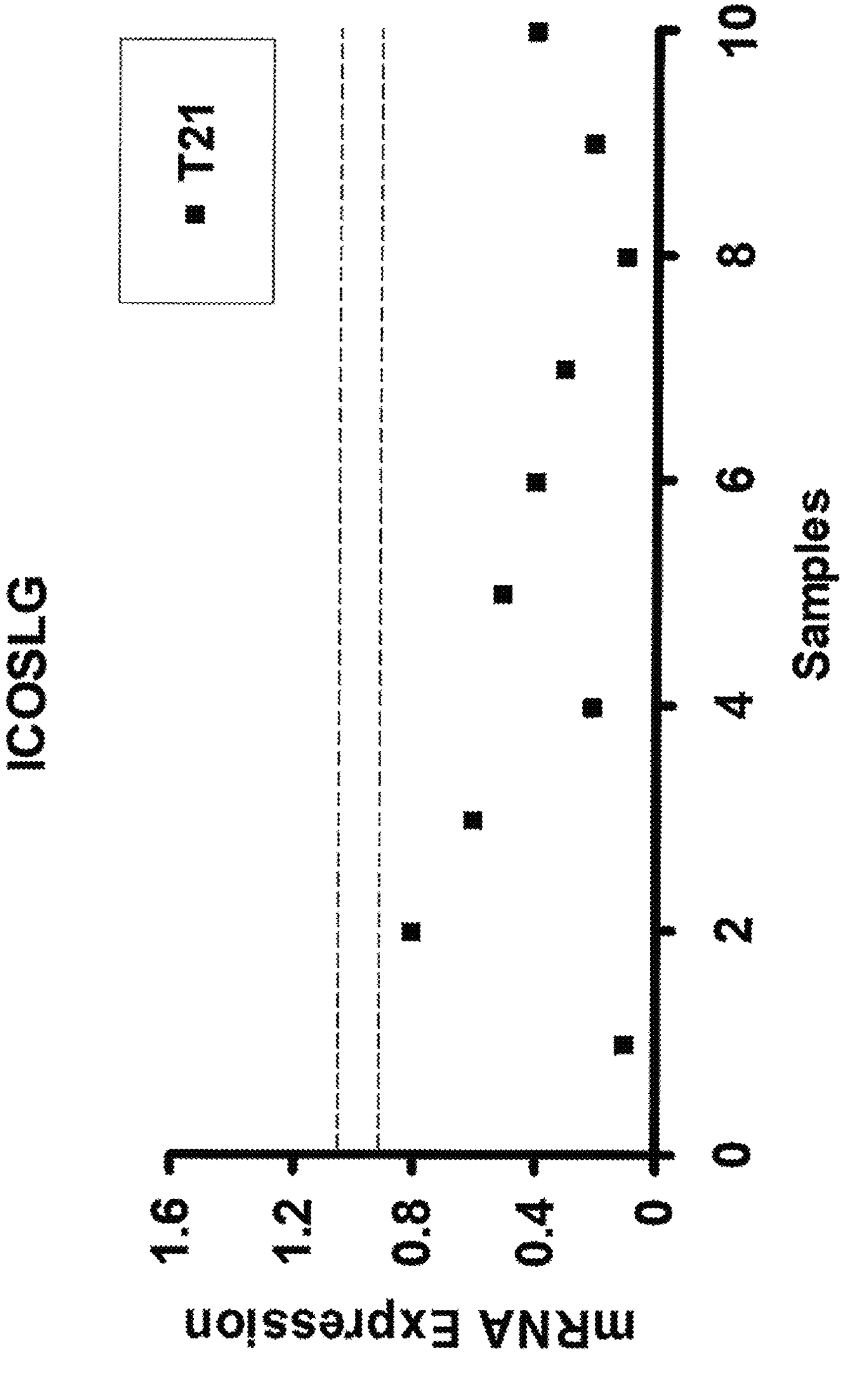
Figure 5H:
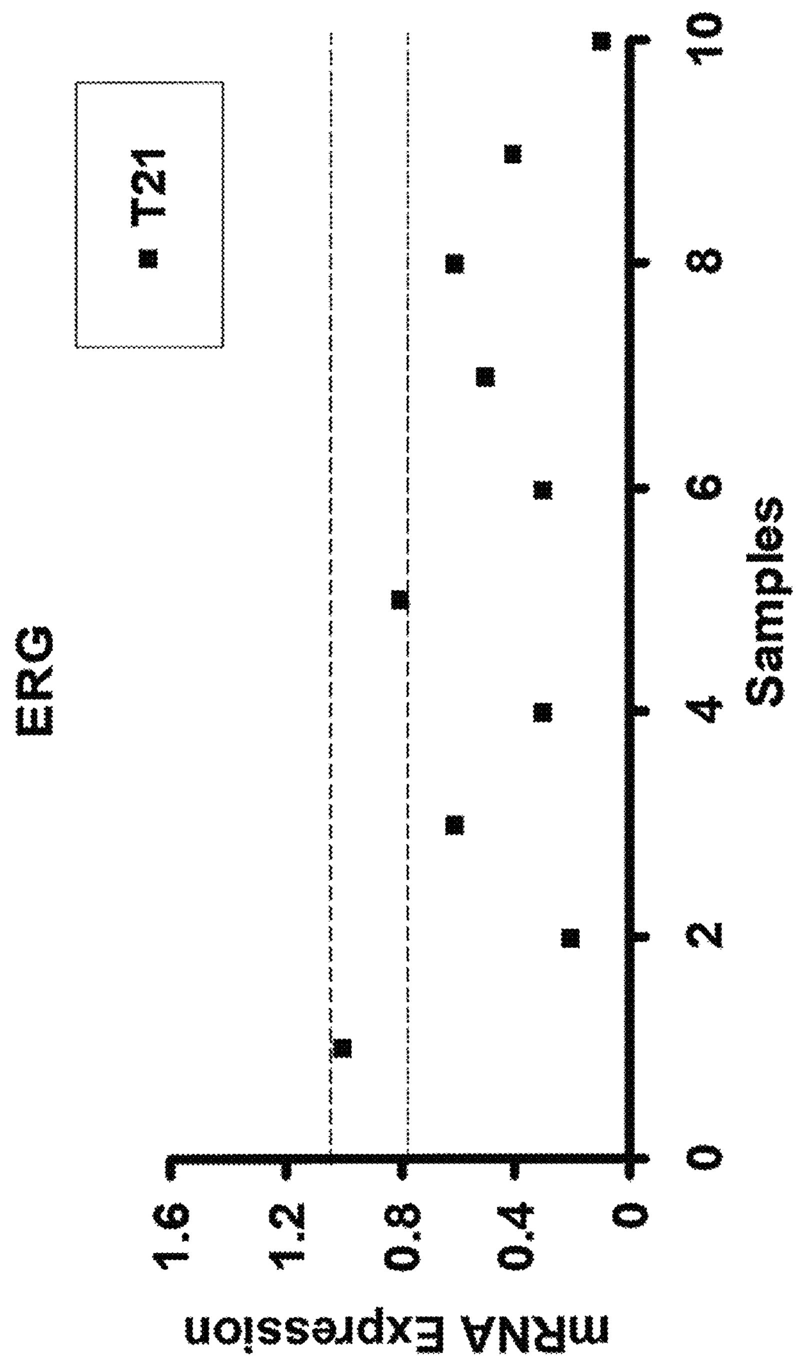
Figure 5I:
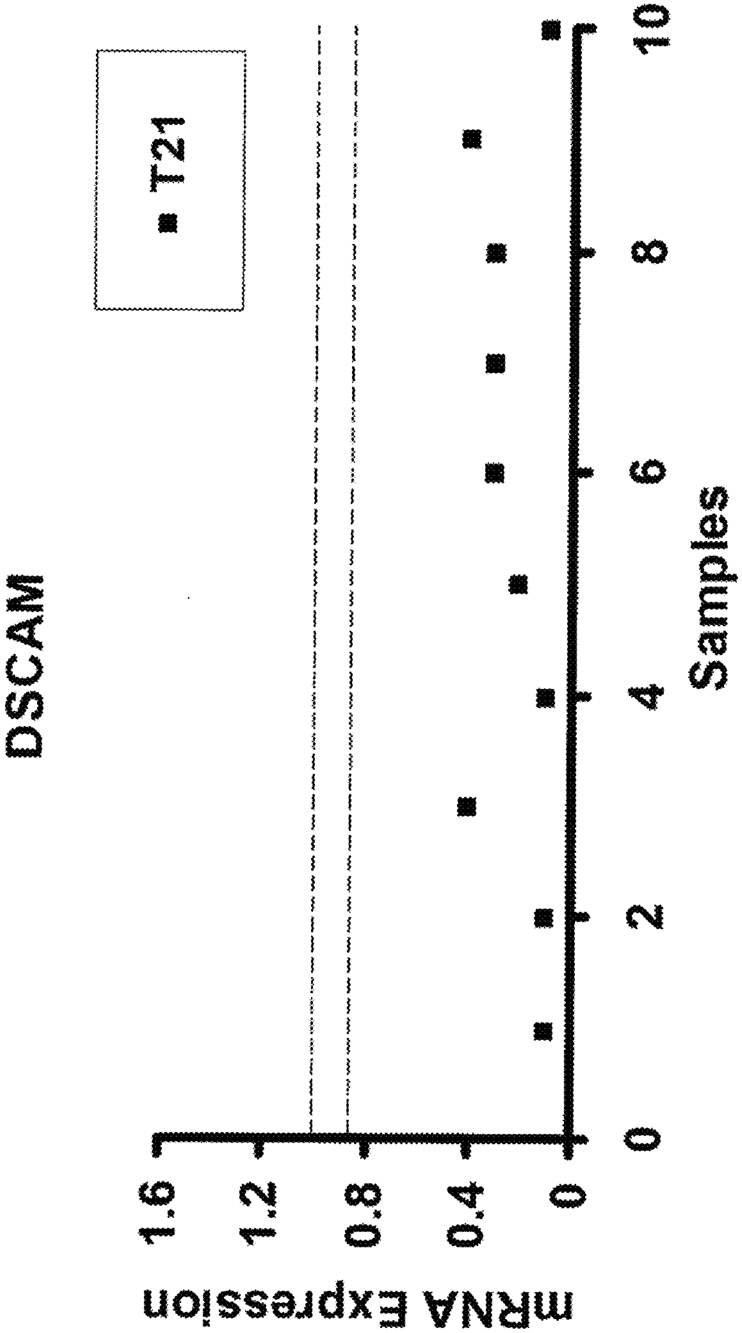
Figure 5J:
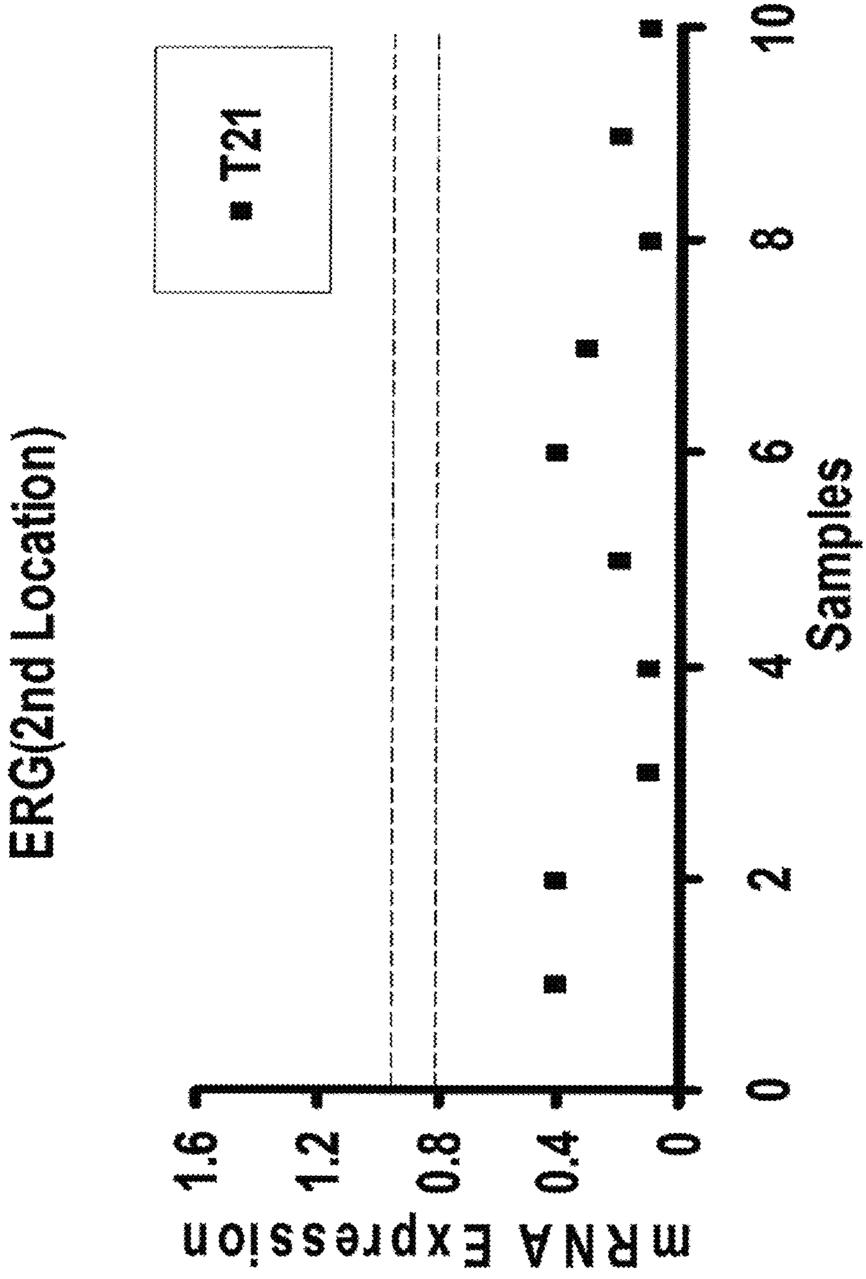
Figure 5K:
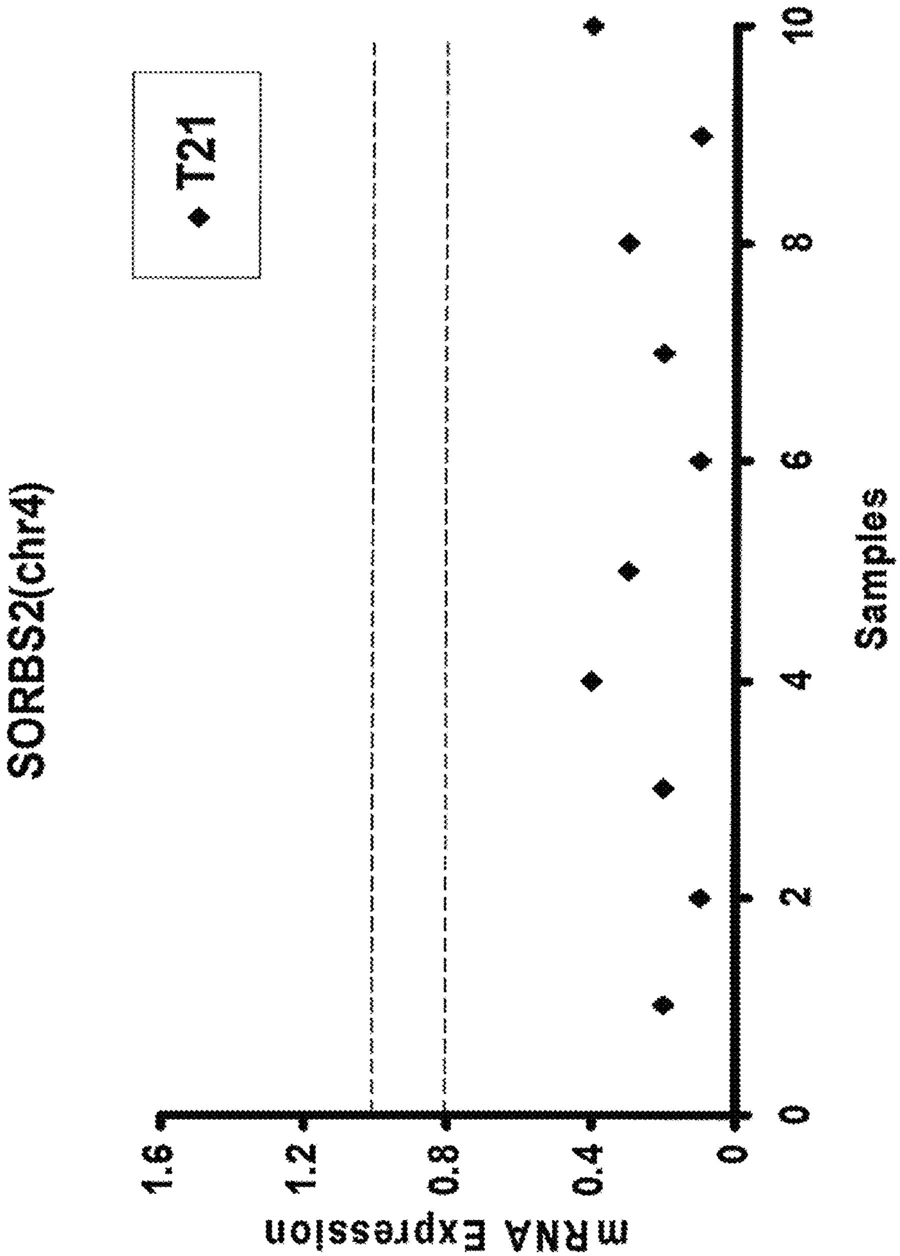
Figure 5L:
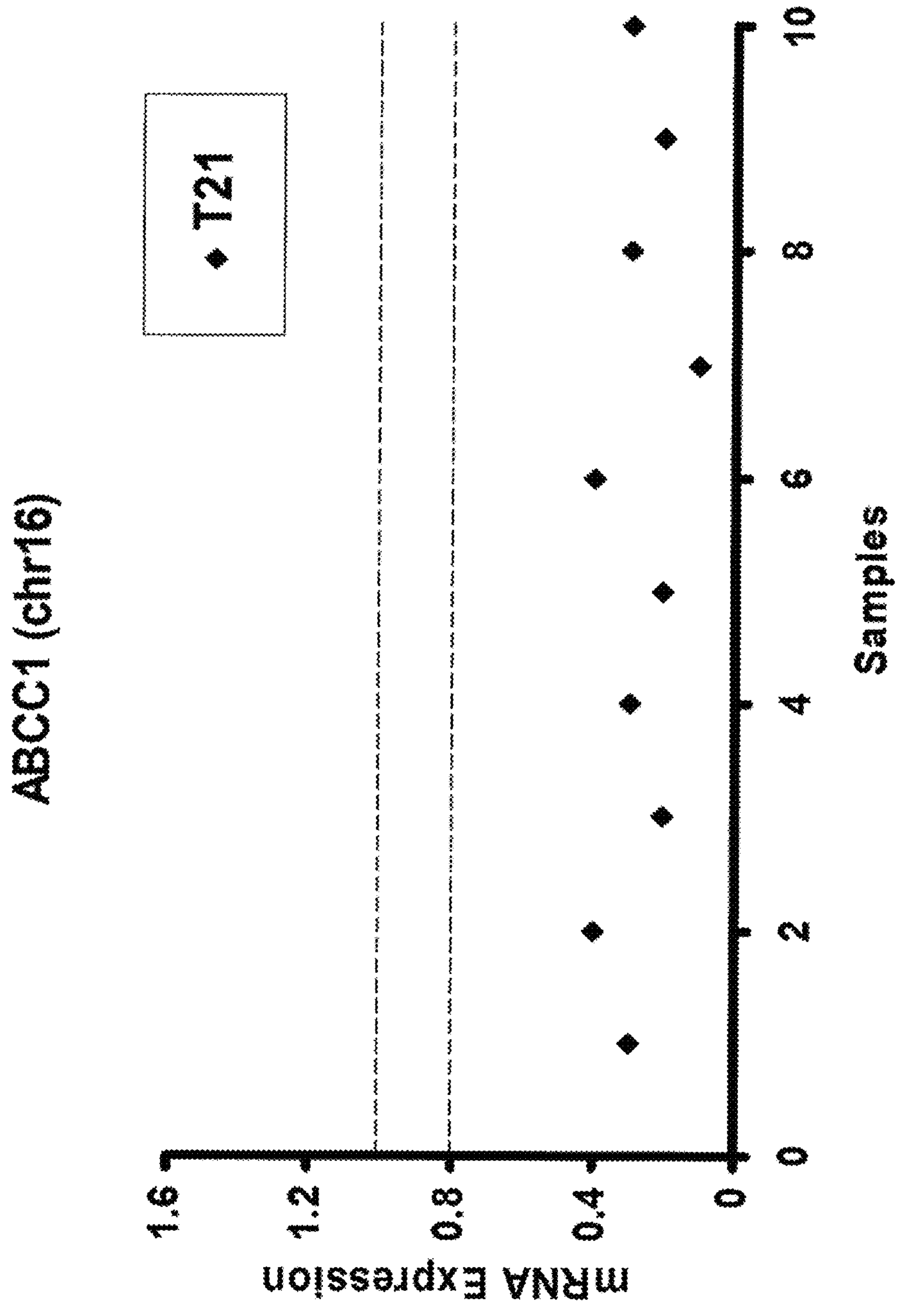
Figure 5M:
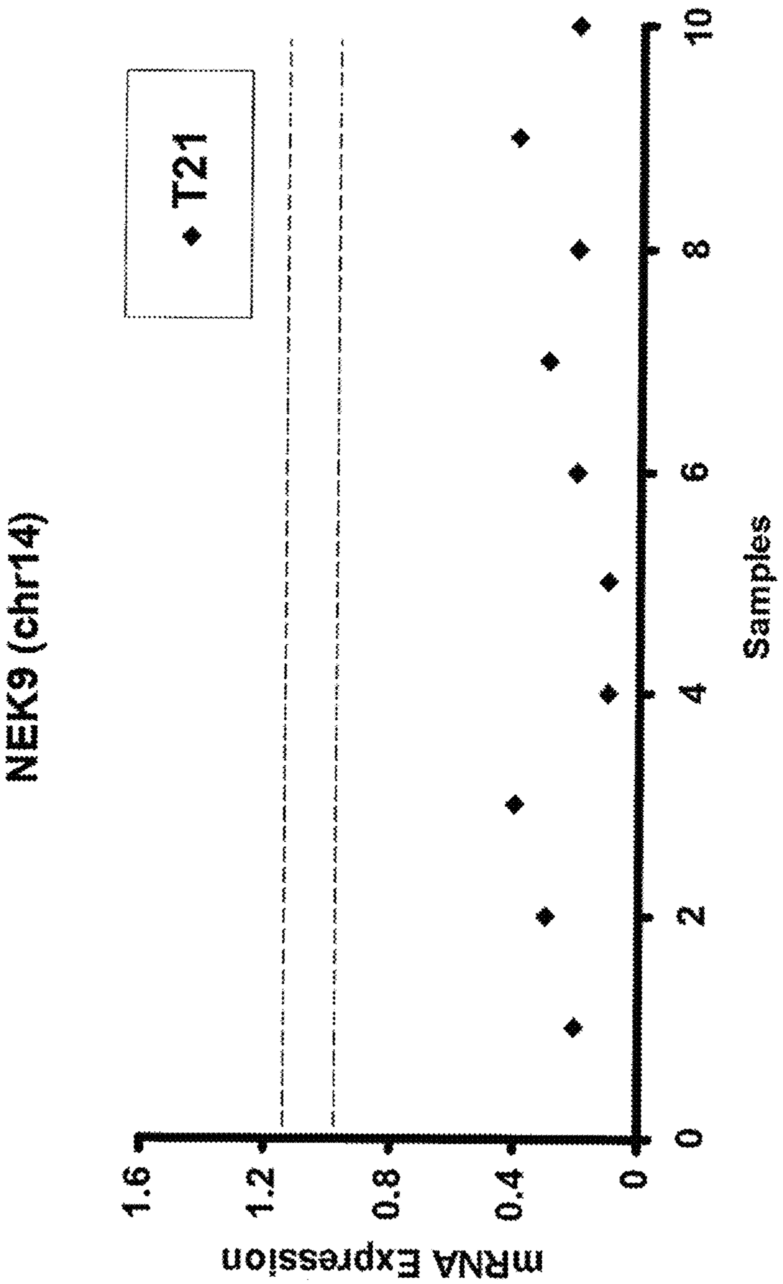
Figure 5N:
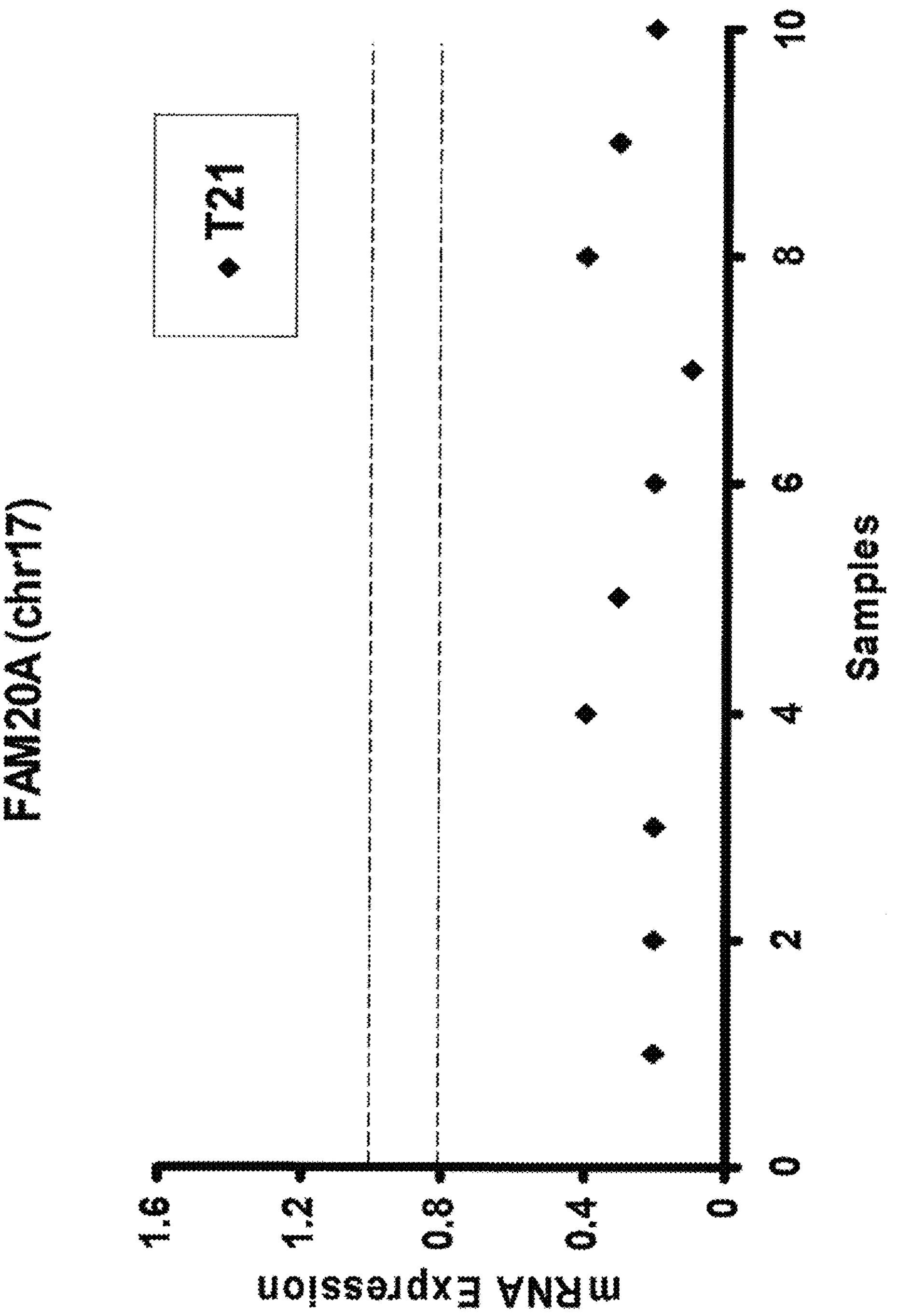
Figure 5O:
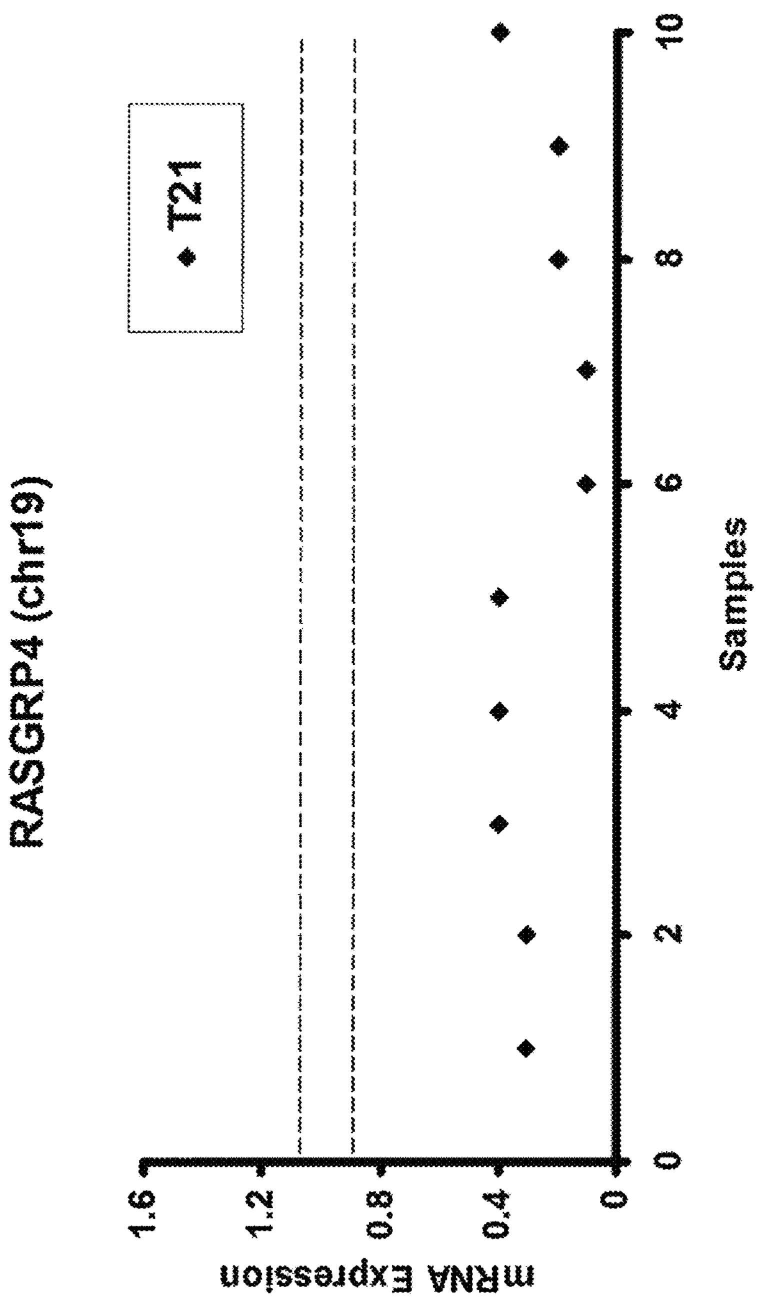

Provided herein are methods for determining whether a subject has trisomy 21. In one embodiment, a method may include screening a fetus for trisomy 21. The method may include measuring a plurality of trisomy 21 biomarkers in a biological sample obtained from a first pregnant female, wherein the plurality of trisomy 21 biomarkers is chosen from any combination of the nucleic acids or a complement thereof. In one embodiment, the fetus of the first pregnant female is at least 6 weeks post-implantation, or at least 7 weeks, or at least 8 weeks, or at least 9 weeks, or at least 10 weeks, or at least 12 weeks through the end of pregnancy. The pregnant female may also have a pregnancy that is less than 32 weeks, less than 24 weeks, or less than 18 weeks.

The method may also include identifying the fetus as having trisomy 21 if expression of the plurality of biomarkers is altered to a statistically significant degree in the biological sample (e.g., first biological sample) compared to a second biological sample from a second pregnant female carrying a fetus not having trisomy 21. The method may also include identifying the fetus as not having trisomy 21 if expression of the plurality of biomarkers is not altered to a statistically significant degree in the first biological sample compared to a second biological sample from a second pregnant female carrying a fetus not having trisomy 21. In one embodiment, expression of a trisomy 21 biomarker is altered to a statistically significant degree if it is outside the 95% confidence interval for that trisomy 21 biomarker. In one embodiment, the method may further include recommending a genetic test chosen from amniocentesis, cordocentesis, and chorionic villus sampling or a combination thereof.

In one embodiment, the plurality of trisomy 21 biomarkers may include at least 6 trisomy 21 biomarkers, wherein the pregnant mother having at least 6 biomarkers whose expression is altered to a statistically significant degree to identify the fetus as having trisomy 21. In one embodiment, the plurality of trisomy 21 biomarkers includes at least 11 trisomy 21 biomarkers, and wherein the pregnant mother having their expression not altered to a statistically significant degree to identify the fetus as having trisomy 21. The plurality of trisomy 21 biomarkers may include at least 6 biomarkers, at least 10 biomarkers, at least 11 biomarkers, at least 24 biomarkers, at least 25 biomarkers, at least 27 biomarkers, at least 30 biomarkers, at least 40 biomarkers, at least 43 biomarkers, at least 45 biomarkers, at least 50 biomarkers and at least 54 biomarkers.

In one embodiment, the trisomy 21 biomarkers may be selected from polynucleotides encoded by chromosome 21, or from polynucleotides encoded by any of chromosomes 1-20, 22 or X. In one embodiment, the trisomy 21 biomarkers may be selected from polynucleotides that are up-regulated in the first pregnant female carrying a fetus with trisomy 21 compared to the second pregnant female carrying a fetus not having trisomy 21. In one embodiment, the trisomy 21 biomarkers may be selected from polynucleotides that are down-regulated in the first pregnant female carrying a fetus with trisomy 21 compared to the second pregnant female carrying a fetus not having trisomy 21.

In one embodiment, the method may further include obtaining the biological sample from the first pregnant female. The obtaining may include obtaining a blood sample. The blood sample may be processed to remove cells from the blood sample. The blood sample may be processed to obtain, and optionally isolate, cell-free plasma RNA. In one embodiment, the method may further include converting RNA polynucleotides present in the biological sample into cDNA molecules, and the measuring includes hybridization between a cDNA molecule and a complementary trisomy 21 biomarker. In one embodiment, the complementary trisomy 21 biomarker is in solution during the hybridization, and in one embodiment, the complementary trisomy 21 biomarker is immobilized on a solid support.

In one embodiment, a method may include detecting trisomy 21 in a fetus. The method may include detecting trisomy 21 biomarkers in a biological sample to yield an expression level of each detected trisomy 21 biomarker in a biomarker combination. In one embodiment, the biological sample includes plasma from a pregnant female. In one embodiment, the fetus of the first pregnant female is at least 6 weeks post-implantation. The method may also include comparing the expression level of each detected trisomy 21 biomarker in a combination of biomarkers to the expression level of the trisomy 21 biomarker in pregnant females carrying a fetus without trisomy 21. In one embodiment, an expression level of a detected trisomy 21 biomarker that is outside the 95% confidence interval for that trisomy 21 biomarker indicates the expression level of the trisomy 21 biomarker is altered. In another embodiment, the expression level of the detected trisomy 21 biomarker is determined by application of a machine learning algorithms that analyzes patterns and performs machine ranking. In one embodiment, at least 6 or 10 trisomy 21 biomarkers are detected. In one embodiment, a fetus carried by the pregnant female is identified as carrying a fetus having trisomy 21 when at least 6 biomarkers are outside the 95% confidence interval. In one embodiment, the method may further include recommending a genetic test chosen from amniocentesis, cordocentesis, or chorionic villus sampling. In one embodiment, the pregnant female and the pregnant females used to establish the 95% confidence interval for each trisomy 21 biomarker may be matched with respect to a co-variable such as gestational stage or ethnicity or a combination thereof.

In one embodiment, the trisomy 21 biomarkers may be selected from polynucleotides encoded by chromosome 21, or from polynucleotides encoded by any of chromosomes 1-20, 22 or X. In one embodiment, the trisomy 21 biomarkers may be selected from polynucleotides that are up-regulated in the pregnant female carrying a fetus with trisomy 21 compared to the pregnant females carrying a fetus not having trisomy 21. In one embodiment, the trisomy 21 biomarkers may be selected from polynucleotides that are down-regulated in the pregnant female carrying a fetus with trisomy 21 compared to the pregnant females carrying a fetus not having trisomy 21.

In one embodiment, the method may further include obtaining the biological sample from the first pregnant female. The obtaining may include obtaining a blood sample. The blood sample may be processed to remove cells from the blood sample. The blood sample may be processed to obtain, and optionally isolate, cell-free plasma RNA. In one embodiment, the method may further include converting RNA polynucleotides present in the biological sample into cDNA molecules, and the measuring includes hybridization between a cDNA molecule and a complementary trisomy 21 biomarker. In one embodiment, the complementary trisomy 21 biomarker is in solution during the hybridization, and in one embodiment, the complementary trisomy 21 biomarker is immobilized on a solid support.

In one embodiment, a method may include detecting trisomy 21 in a fetus. The method may include detecting trisomy 21 biomarkers in a biological sample from a pregnant female to yield a sample expression profile. In one embodiment, the biological sample includes plasma from a pregnant female. In one embodiment, the T21 biomarkers may be chosen from a sequence of (e.g., at least 5, 10, or 15 consecutive) nucleotides selected from any combination of nucleic acid biomarkers as defined herein, or a complement thereof. In one embodiment, the fetus of the first pregnant female is greater than 8 weeks post-implantation. The method may also include comparing the sample expression profile with a reference expression profile, wherein a difference between the sample expression profile and the reference expression profile is indicative of the presence or absence of trisomy 21 in the fetus. In one embodiment, the reference expression profile is from at least one second pregnant female carrying a fetus without trisomy 21, and a difference between the sample expression profile and the reference expression profile is indicative of the presence of trisomy 21. In one embodiment, the reference expression profile is from at least one second pregnant female carrying a fetus with trisomy 21, and a difference between the sample expression profile and the reference expression profile is indicative of the absence of trisomy 21. In one embodiment, the method may further include recommending a genetic test chosen from amniocentesis, cordocentesis, and chorionic villus sampling.

In one embodiment, the difference between the sample expression profile and the reference expression profile is statistically significant. In one embodiment, the sample expression profile includes at least 6 or 10 trisomy 21 biomarkers. In one embodiment, the trisomy 21 biomarkers may be selected from polynucleotides encoded by chromosome 21, or from polynucleotides encoded by any of chromosomes 1-20, 22 or X. In one embodiment, the trisomy 21 biomarkers may be selected from polynucleotides that are up-regulated in the first pregnant female carrying a fetus with trisomy 21 compared to the second pregnant female carrying a fetus not having trisomy 21. In one embodiment, the trisomy 21 biomarkers may be selected from polynucleotides that are down-regulated in the first pregnant female carrying a fetus with trisomy 21 compared to the second pregnant female carrying a fetus not having trisomy 21. In one embodiment, the first pregnant female with a fetus having trisomy 21 and the second pregnant female with a euploid fetus may be matched with respect to a co-variable such as gestational stage and ethnicity.

In one embodiment, the method may further include obtaining the biological sample from the first pregnant female whose fetus may have trisomy 21. The obtaining may include obtaining a blood sample. The blood sample may be processed to remove cells from the blood sample. The blood sample may be processed to obtain, and optionally isolate, cell-free plasma RNA. In one embodiment, the method may further include converting RNA polynucleotides present in the biological sample into cDNA molecules, and the measuring includes hybridization between a cDNA molecule and a complementary trisomy 21 biomarker. In one embodiment, the complementary trisomy 21 biomarker is in solution during the hybridization, and in one embodiment, the complementary trisomy 21 biomarker is immobilized on a solid support.

In one embodiment, an article includes a substrate and a plurality of different polynucleotides. In one embodiment, the polynucleotides are selected from any combination nucleic acids as described herein (e.g., defined groups), or a complement thereof. In one embodiment, the T21 biomarkers are selected from a sequence of at least 5, 10 or 15 consecutive nucleotides selected from any combination of the nucleic acid biomarkers, or a complement thereof. The polynucleotides are immobilized onto a surface of the substrate. In one embodiment, the polynucleotides are immobilized on the substrate surface to form a microarray. In one embodiment, at least 10 polynucleotides are immobilized on the substrate surface.

Also provided herein are kits. In one embodiment, a kit includes an article having a substrate, a plurality of different polynucleotides immobilized onto a surface of the substrate, and packaging materials and instructions for use. In one embodiment, the polynucleotides are selected from any combination of the defined groups of nucleic acid biomarkers, or a complement thereof. In one embodiment, the T21 biomarkers are selected from a sequence of at least 5, 10, or 15 consecutive nucleotides selected from any combination of the defined groups of the nucleic acid biomarkers, or a complement thereof. In one embodiment, the polynucleotides are immobilized on the substrate surface to form a microarray.

The term "and/or" means one or all of the listed elements or a combination of any two or more of the listed elements.

The words "preferred" and "preferably" refer to embodiments of the invention that may afford certain benefits, under certain circumstances. However, other embodiments may also be preferred, under the same or other circumstances. Furthermore, the recitation of one or more preferred embodiments does not imply that other embodiments are not useful and is not intended to exclude other embodiments from the scope of the invention.

The terms "comprises" and variations thereof do not have a limiting meaning where these terms appear in the description and claims.

Unless otherwise specified, "a," "an," "the," and "at least one" are used interchangeably and mean one or more than one.

Also herein, the recitations of numerical ranges by endpoints include all numbers subsumed within that range (e.g., 1 to 5 includes 1, 1.5, 2, 2.75, 3, 3.80, 4, 5, etc.).

For any method disclosed herein that includes discrete steps, the steps may be conducted in any feasible order. And, as appropriate, any combination of two or more steps may be conducted simultaneously.

Provided herein are polynucleotides useful for determining whether a subject, or a subject's fetus, has trisomy 21 (T21), and methods for using the polynucleotides. The methods described herein, and other embodiments disclosed herein such as reagents and kits, are based in part on the surprising discovery of a plurality of molecular markers, the expression levels of which consistently differentiate between healthy subjects and subjects with T21. The molecular markers are derived from coding regions whose altered expression in an affected subject, as measured from an easily obtained biological sample, is indicative of the subject, or the subject's fetus, having T21. As used herein, the term "polynucleotide" refers to a polymeric form of nucleotides of any length, either ribonucleotides or deoxynucleotides, and includes both double- and single-stranded DNA and RNA. A polynucleotide can be obtained directly from a natural source, or can be prepared with the aid of recombinant, enzymatic, or chemical techniques. A polynucleotide can be linear or circular in topology. The terms cDNA, oligonucleotide, probe, and nucleic acid are included within the definition of polynucleotide and these terms are used interchangeably. The term polynucleotide also includes peptide nucleic acids (Nielsen et al., 1991, Science. 254: 1497-500), and other nucleic acid analogs and nucleic acid mimetics (see, e.g., McGall et al., U.S. Pat. No. 6,156,501).

In one embodiment, a method provided herein includes detecting one or more T21 biomarkers in a biological sample. As used herein, a "biological sample" refers to a sample of tissue or fluid obtained from a subject, including but not limited to, for example, whole blood, blood plasma, serum, lymph fluid, synovial fluid, cerebrospinal fluid, urine, and saliva. In one embodiment, a biological sample includes serum. In one embodiment the methods provided herein are directed to non-invasive methods of detecting T21, and in such an embodiment a biological sample may be a fluid. In one embodiment, a biological sample includes blood plasma. In one embodiment, a biological sample includes whole blood. As used herein, "subject" refers to a prenatal or postnatal human. A prenatal human includes a fetus. Unless indicated otherwise, as used herein the term "fetus" refers to a human during prenatal development from the time of first cell division until birth. The fetus may be at any age after implantation. For instance, the fetus may be at 2 weeks post-implantation (PI), 4 weeks PI, 6 weeks PI, 8 weeks PI, 10 weeks PI, 12 weeks PI, 14 weeks PI, 16 weeks PI, 18 weeks PI, 20 weeks PI, etc. In one embodiment, the fetus is between 6 weeks and 20 weeks PI, or between 7 weeks and 14 weeks PI, or 15-20 weeks PI. A postnatal human refers to an individual at any stage of development after birth, including a newborn, a child, an adolescent, or an adult, and includes a pregnant human mother. In one embodiment where the subject is a pregnant human mother, the mother does not have T21. In the embodiment where the subject is a pregnant human mother, a method provided herein allows one to determine if the fetus carried by the pregnant mother has T21.

As used herein, a "T21 biomarker" is a polynucleotide that is indicative of T21 in a subject. A T21 biomarker is indicative of T21 when the expression level or quantity of the biomarker is altered more often in a subject having T21 compared to a healthy subject, which expression level may be higher for a subject having T21 for certain biomarkers, lower for a subject having T21, or in some instances the biomarker may be higher or lower for the subject having T21. The change in the expression level from a standard (e.g., subject without T21) to a statistically significant degree for a combination of biomarkers, whether the change is upregulation or downregulation, can provide the indication of T21 in a subject. In some instances, the same biomarker can increase in one patent but decrease in another patient, but along with the other identified combination of biomarkers, the change itself for that biomarker provides an indication of the subject having T21. In some aspects, a panel or combination of biomarkers can be assessed for a change in expression, and when a certain percentage thereof change expression, whether upregulated or downregulated, the subject is identified as having T21. A T21 biomarker having an altered expression level or quantity is one that is expressed at a greater level (e.g., over-expressed, upregulated) or expressed at a lower level (e.g., under-expressed, downregulated) when compared to a healthy subject or compared against a standard (e.g., average of a plurality of expression profiles for the biomarkers in subjects without T21). Whether the expression level or quantity of a biomarker in a subject having T21 is altered, e.g., greater than or less than the expression level or quantity of the biomarker in a healthy subject or standard, is determined using routine statistical methods or machine learning techniques using pattern recognition and ranking.

It should be understood that the term "biomarker," can, depending on the context, refer to the physical polynucleotide itself or to a graphical or numerical representation of the polynucleotide such as an amount of fluorescence present at a spot on a microarray, a band on a gel image, a numerical value, and the like. For example, the amount of fluorescence at a particular spot on a microarray may be referred to as a T21 biomarker when the fluorescence is linked to a specific polynucleotide. This graphical or numerical biomarker reflects the existence of the underlying expressed polynucleotide in the test sample, which gave rise to an expression level.

In one embodiment, the detecting of one or more T21 biomarkers in a biological sample yields an expression level of each detected biomarker. In one embodiment, the detecting of two or more T21 biomarkers in a biological sample yields a sample expression profile. An "expression level" is any physical representation of the amount of a selected T21 biomarker, as determined from one or more biological samples from a subject. A "sample expression profile" is any physical representation of the amounts of a set of two or more selected T21 biomarkers, as determined from one or more biological samples from a subject. The subject may be one known to have T21, known to have T21 of a particular type (for instance, 47XX+21, 47XY+21, or mosiac), known to be free of T21, or the status of T21 in the subject may be unknown. In one embodiment, a sample expression profile for a subject may include information from a single biological sample that has been analyzed for T21 biomarker expression levels. In one embodiment, a sample expression profile for a subject may include information from multiple types of biological samples that have been analyzed separately for T21 biomarker expression levels.

The terms "normal" and "healthy" are used herein interchangeably to refer to a subject or subjects who do not have a chromosomal abnormality associated with T21. A normal or healthy sample refers to a sample or samples obtained from a normal/healthy subject.

One skilled in the art will appreciate that more than one sample from a subject may be examined. The expression level and/or sample expression profile may be represented in visual graphical form, for example on paper or on a computer display, in a three dimensional form such as an array, and/or stored in a computer-readable medium. An expression level and/or sample expression profile may correspond to a particular status of T21 (e.g., presence or absence of T21) or type (e.g., 47XX+21, 47XY+21, or mosiac), and thus provide a template for comparison to a patient sample. A negative control expression level and/or a control expression profile, also referred to herein as a reference expression level and a reference expression profile and a standard expression profile, can be obtained by analyzing a biological sample from at least one healthy subject, or multiple samples obtained from a group of healthy subjects. A positive control expression level can be from one or more subjects identified as having comparable T21 in terms of type. When multiple samples from a group are used, the levels of expression of each detected T21 biomarker may be an average, consensus, or composite derived from the multiple samples. Similarly, comparable profiles can be obtained for age-matched and/or sex-matched subjects, and comparable profiles can be obtained for pregnant mothers at the same or similar stage of pregnancy. In one embodiment, expression levels and/or expression profiles can be obtained from a pregnant mother, and if the fetus is later determined to be healthy, such expression levels and/or expression profiles can be used as control expression levels and/or control expression profiles.

One skilled in the art will appreciate that multiple nontest factors may alter the marker level measured and may be mathematically adjusted by one of several well known and routine approaches. For example, the median level of each T21 biomarker may be determined at each gestational epoch in control women. If there is a statistically significant change with gestation, regression analysis of median on gestation weighted for the number of samples per epoch may be performed to determine the normal median curve that best fits the data. All results, both affected and unaffected pregnancies, may be expressed as multiples of the gestation-specific median (MoM) based on the fitted curve. In controls, potential co-variables may be examined, including maternal weight, smoking, prior preterm birth, diabetes or use of prophylactic progesterone and ethnicity, to see if they are significantly associated with the MoM. As the sample pool grows, it is likely other variables (such maternal medical diseases) may need to be considered. Plasma levels of fetal-placental derived sequences may decline on average with increased adiposity due to a fixed output being diluted into a greater volume of blood. If any co-variables are confirmed, the levels can be adjusted by, for instance, dividing the observed MoM by the expected median according to the co variable level found in unaffected pregnancies. Typically, the non-parametric Wilcoxon Rank Sum Test is used to select the subset of markers where there is a significant difference in the MoM distribution between affected and control pregnancies. As a large number of potential markers are to be tested, an extreme P-value of 0.005 may be used for an initial selection.

The risk of T21 may be modeled by the a priori risk of the disorder expressed as odds (a:b) multiplied by the likelihood ratio (LR) for the marker profile derived from multivariate Gaussian frequency distributions. All current aneuploidy and pre-eclampsia markers follow an approximately log Gaussian distribution over most of their range for both affected and unaffected pregnancies, and it is expected to be true for the T21 biomarkers disclosed herein. In some embodiments, the data may show the distribution is not Gaussian. [These Gaussian distributions are defined by the marker sequence means and standard deviations after log transformation. For a single marker, the LR is calculated by the ratio of the heights of the two overlapping distributions at the specific level. For extreme results that fall beyond the point where the data fits a Gaussian distribution, it is standard practice to use the LR at the end of the acceptable range. The method is the same for more than one marker except that the heights of multivariate log Gaussian distributions are used. These are defined, in addition to means and standard deviations, by the correlation coefficients between markers within affected and unaffected pregnancies. In some embodiments, machine learning algorithms may be used for analysis, which can include pattern recognition and ranking.

The method of numerical integration may be used to model the best combination of markers from the initial subset. This involves division of each marker operating range into up to 100 equal units, calculation of the volumes under the affected and unaffected multivariate Gaussian curves risk as well as the risk in the mid-point of the volume. This determines the distribution of risks in affected and unaffected pregnancies. These distributions will be calculated for all marker combinations and the sensitivity compared for a fixed specificity.

A second approach may be considered based on the well-known fact that a strong association does not guarantee effective discrimination between affected and unaffected. Nor does a high AUC guarantee good prediction of actual risk. Hence, model calibration via reclassification can be useful in order to accept only those markers least likely to have been identified at random. Prognostic models may be built for predictive accuracy after confirmed T21 with only non-T21 biomarker variables (age, race, maternal weight, gestation age, maternal comorbidities, etc.) and then build prognostic models to include T21 biomarkers. Dimensionality of the models may be reduced by translating the RNA marker contributions into a few components or composite scores. Principal components analysis may be used to derive the principal components of the T21 biomarkers factors. For instance, leading components that explain more than 85 percent of the total variation in genetic predictors may be retained and included in a prognostic model. Models that are more complicated (more predictors) may appear to have better predictive performance even if that is not the case. Therefore, the model performance may be quantified with respect to calibration and discrimination. Calibration may be examined by comparing the observed with the expected frequencies while the discriminatory accuracy may be assessed using the receiver operating characteristic (ROC) curve estimation for survival data. The true positive fraction or sensitivity and the false positive fraction (1-specificity) may be discussed using the derived prognostic models. For instance, the discriminatory accuracy may be compared between the models with and without validated genetic markers using the area under a ROC curve (AUC). Other validation techniques including cross-validation and bootstrap methods can also be carried to shed some insights about a model's adequacy. Alternatively, prognostic models can be constructed for T21 status (affected or unaffected) using logistic regression models. Modeling procedures may be similar to those previously described for routinely used Cox models.

In one embodiment, a T21 biomarker is RNA. In one embodiment, the RNA that is detected is cell-free, and is referred to herein as cell-free RNA. Cell-free RNA includes coding RNA (mRNA) and non-coding RNAs such as siRNA, miRNA, snoRNA, piRNA, exRNA, scaRNA, long ncRNAs and snRNA. In one embodiment, cell-free RNA is from whole blood, blood plasma, or serum, and is referred to herein as cell-free plasma (CFP) RNA. CFP RNA includes coding RNA (mRNA) and non-coding RNAs such as, but not limited to, siRNA, miRNA, snoRNA, and snRNA. For instance, when the sample is blood, the CFP RNA to be detected is present in the plasma portion of the blood. Thus, in one embodiment, a biological sample is processed to remove cells prior to the detecting. In one embodiment, a biological sample is processed to minimize cell lysis. In one embodiment, the CFP RNA that is detected may be mRNA, non-coding RNA, or the combination thereof. Optionally, the CFP RNA may be isolated.

RNA may be obtained from a biological sample using routine methods. In one embodiment, RNA is obtained using a process based on a phenol/guanidium isothiocyanate/glycerol phase separation. Such a process may result in large quantities of CFP nucleic acid with total RNA yields of 8-30 ug or more from only 2 mL of plasma and full range of RNAs including not only mRNA but also small noncoding RNAs such as miRNA and snoRNA. This amount is more than enough for both array and RNAseq technologies and the performance of numerous PCR reactions using a clinically practical, single patient sample.

The RNA isolation method described herein allows for the isolation of 8 micrograms to 30 micrograms of CFP RNA from a 2 mL sample, which is more than enough for both microarray gene screening and PCR validation. The method may include obtaining 2 mL or more of sample from a subject, such as plasma, and following the steps as described in Example 1.

The analysis of samples of blood obtained from pregnant mothers who later gave birth to healthy infants or gave birth to infants with T21 has led to the discovery of T21 biomarkers. Examples of T21 biomarkers are described at SEQ ID NO:8-3,273. Different combinations of the T21 biomarkers listed at SEQ ID NO:8-3,273, or the complement thereof, allow the skilled person to predict whether the fetus carried by a pregnant mother has T21. Changes in the expression levels of these biomarker polynucleotides in a subject, as measured in a biological sample from the subject, thus may be used to indicate the presence, absence, or type or T21 in a subject, such as a fetus carried by a mother, or an infant, child, adolescent, or adult.

The panel of T21 biomarkers includes a subset encoded by chromosome 21 (e.g., SEQ ID NOs: 3,028-3,065 and 3,238, see FIGS. 2A and 2B). That subset includes polynucleotides found to be up-regulated in a pregnant mother carrying a fetus that is T21 when compared to a pregnant mother carrying a normal fetus. That subset also includes polynucleotides found to be down-regulated in a pregnant mother carrying a fetus that is T21 when compared to a pregnant mother carrying a normal fetus.

The panel of biomarkers includes a subset encoded by chromosomes other than chromosome 21, e.g., chromosomes 1-20, 22, and/or x (e.g., SEQ ID NOs:8-3,027, 3,066-3,227 and 3,239-3,248, see FIGS. 2A and 2B). That subset includes polynucleotides found to be up-regulated in a pregnant mother carrying a fetus that is T21 when compared to a pregnant mother carrying a normal fetus. That subset also includes polynucleotides found to be down-regulated in a pregnant mother carrying a fetus that is T21 when compared to a pregnant mother carrying a normal fetus.

The panel of T21 biomarkers includes a subset that are mRNAs (e.g., SEQ ID NO:8-3,250) and a subset that are small non-coding RNAs (SEQ ID NO:3,251-3,248). An expression level of a T21 biomarker may include polynucleotide expression level information for one polynucleotide chosen from SEQ ID NO:8-3,248, obtained from a biological sample from a subject. A sample expression profile may include polynucleotide expression level information for two or more polynucleotides chosen from SEQ ID NO:8-3,2473, obtained from a biological sample from a subject, for instance, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30. A sample expression profile may include polynucleotide expression level information for no greater than 30 polynucleotides chosen from SEQ ID NO:8-3,273, obtained from a biological sample from a subject, for instance, no greater than 30, no greater than 29, no greater than 28, no greater than 27, no greater than 26, no greater than 25, no greater than 24, no greater than 23, no greater than 22, no greater than 21, no greater than 20, no greater than 19, no greater than 18, no greater than 17, no greater than 16, no greater than 15, no greater than 14, no greater than 13, no greater than 12, no greater than 11, no greater than 10, no greater than 9, no greater than 8, no greater than 7, no greater than 6, or no greater than 5.

The skilled person will recognize that detecting a T21 biomarker present in a subject may not require use of an entire nucleotide sequence disclosed at any of SEQ ID NO:8-3,273. A nucleotide sequence used in a method provided herein is of a length that is at least substantially unique for a T21 biomarker to specifically hybridize with a RNA, such as a CFP RNA, present in a biological sample. A nucleotide sequence used in a method provided herein may be RNA, DNA, or RNA/DNA hybrid.

In one embodiment, a T21 biomarker present in a biological sample may be a polynucleotide that contains or consists of the sequence which defines the T21 biomarker target or complement thereof, or associated RNA or DNA thereof. The T21 biomarker may be identical to one of SEQ ID NOs:8-3,248, or can be a complement thereof, sense or antisense, as well as a sequence that hybridizes therewith under suitable conditions. When provided as a DNA sequence, the biomarker also includes the corresponding RNA sequence. When provided as an RNA sequence, the biomarker also includes the corresponding DNA sequence.

In one embodiment, a T21 biomarker used to detect a RNA present in a biological sample, such as a CFP RNA, may be at least 6, at least 15, at least 20, at least 25, at least 30, at least 35, or at least 40 nucleotides in length, and so on, of a sequence selected from SEQ ID NO: 8-3,273, or the complement thereof. In one embodiment, a T21 biomarker may include a sequence selected from SEQ ID NO: 8-3,273, or the complement thereof, that is from 10 nucleotides to the full sequence, from 16 nucleotides to 100 nucleotides, from 17 nucleotides to 50 nucleotides, from 18 nucleotides to 30 nucleotides, from 19 nucleotides to 25 nucleotides, or from 20 to 22 nucleotides. A T21 biomarker selected from SEQ ID NO: 8-3,273 may have perfect identity, at least 95% identity, at least 90% identity, at least 85% identity, or at least 80% identity with a sequence disclosed herein. A T21 biomarker selected from SEQ ID NO: 8-3,273 may have perfect complementarity or at least 95% complementarity, at least 90% complementarity, at least 85% complementarity, or at least 80% complementarity with a sequence disclosed herein. A T21 biomarker may be continuous or it can have one or more bulges or mismatches upon hybridization. A T21 biomarker used to detect a RNA in a biological sample may also include one or more chemical modifications, such as a 2' carbon modification. A T21 biomarker may or may not form an overhang upon hybridization when detecting a RNA present in a biological sample.

"Hybridization" includes any process by which a strand of a nucleic acid sequence joins with a second nucleic acid sequence strand through base-pairing. Hybridization of polynucleotides is affected by such conditions as salt concentration, temperature, or organic solvents, in addition to the base composition, length of the complementary strands, and the number of nucleotide base mismatches between the hybridizing nucleic acids, as will be readily appreciated by those skilled in the art. Stringency conditions depend on the length and base composition of the nucleic acid, which can be determined by techniques well known in the art. Generally, stringency can be altered or controlled by, for example, manipulating temperature and salt concentration during hybridization and washing. For example, a combination of high temperature and low salt concentration increases stringency. The degree of stringency may be based, for example, on the calculated (estimated) melting temperature ($T_m$) of the polynucleotide. Calculation of $T_m$ is well known in the art. For example, "maximum stringency" typically occurs at around $T_m$−5° C. (5° below the $T_m$ of the probe); "high stringency" at around 5-10° below the $T_m$; "intermediate stringency" at around 10-20° below the $T_m$ of the probe; and "low stringency" at around 20-25° below the $T_m$. Maximum stringency conditions may be used to identify a polynucleotide present in a biological sample having strict identity or near-strict identity with a T21 biomarker selected from SEQ ID NO:8-3,248; while high stringency conditions are used to identify a polynucleotide present in a biological sample having about 80% or more sequence identity with a T21 biomarker. Such conditions are known to those skilled in the art and can be found in, for example, Strauss, W. M. "Hybridization With Radioactive Probes," in Current Protocols in Molecular Biology 6.3.1-6.3.6, (John Wiley &

Sons, N.Y. 2000). Both aqueous and nonaqueous conditions as described in the art can be used.

Expression levels of any one or more of the T21 biomarkers described herein may be used to determine the presence, absence, or type of T21 in a subject. In one embodiment, expression levels of one or more T21 biomarkers encoded by chromosome 21 may be used to determine the presence, absence, or type of T21 in a subject. In one embodiment, expression levels of one or more T21 biomarkers encoded by the remaining 21 autosomes (chromosomes 1-22 exclusive of chromosome 21) and X may be used to determine the presence, absence, or type of T21 in a subject. In one embodiment, expression levels of one or more T21 biomarkers encoded by any combination of chromosomes 1-22 and X may be used to determine the presence, absence, or type of T21 in a subject. In one embodiment, expression levels of one or more T21 biomarkers encoded by one chromosome selected from 1-22 and X may be used to determine the presence, absence, or type of T21 in a subject.

In one embodiment, expression levels of one or more T21 biomarkers that are mRNAs may be used to determine the presence, absence, or type of T21 in a subject. In one embodiment, expression levels of one or more T21 biomarkers that are small non-coding RNAs may be used to determine the presence, absence, or type of T21 in a subject. In one embodiment, the T21 biomarkers used may be those that are up-regulated in a pregnant mother carrying a fetus that is T21 when compared to a pregnant mother carrying a normal fetus. In one embodiment, the T21 biomarkers used may be those that are down-regulated in a in a pregnant mother carrying a fetus that is T21 when compared to a pregnant mother carrying a normal fetus. In one embodiment, the T21 biomarkers used may be a combination of those that are up-regulated and those that are down-regulated in a pregnant mother carrying a fetus that is T21 when compared to a pregnant mother carrying a normal fetus.

The number of T21 biomarkers used in an assay to determine the presence, absence, or type or T21 in a subject may vary. The skilled person will appreciate that, generally, the more biomarkers examined, the more accurate the determination of the presence, absence, or type of T21 in a subject; however, the skilled person will also appreciate that there is a minimum number of biomarkers useful for an accurate diagnosis of T21. In one embodiment, the number of T21 biomarkers evaluated in practicing a method provided herein may be at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30. In one embodiment, the number of T21 biomarkers evaluated in practicing a method provided herein may be no greater than 30, no greater than 29, no greater than 28, no greater than 27, no greater than 26, no greater than 25, no greater than 24, no greater than 23, no greater than 22, no greater than 21, no greater than 20, no greater than 19, no greater than 18, no greater than 17, no greater than 16, no greater than 15, no greater than 14, no greater than 13, no greater than 12, no greater than 11, no greater than 10, no greater than 9, no greater than 8, no greater than 7, no greater than 6, or no greater than 5. In one embodiment, the number of CFP RNAs detected varies depending upon whether the fetus or subject is normal or abnormal.

All the T21 biomarkers measured in a subject having T21 may not show altered expression levels when compared to a healthy subject. A subject may be considered to have T21 when at least 60%, at least 65%, at least 70%, at least 75%, at least 80%, at least 85%, at least 90%, at least 95%, or 100% of the T21 biomarkers in a sample expression profile from the subject's biological sample show altered expression when compared to those T21 biomarkers in a negative control expression profile from a healthy subject. For instance, in an embodiment where 10 biomarkers are measured in a biological sample from a subject, such as a pregnant mother carrying a fetus with T21, the subject may be considered to have T21 when at least 6 of the biomarkers in a sample expression profile show altered expression when compared to those T21 biomarkers in a control expression profile from a healthy subject. Some of the T21 biomarkers in a subject not having T21 may show altered expression levels when compared to another healthy subject. A subject may be considered not to have T21 when no greater than 40%, no greater than 35%, no greater than 30%, no greater than 25%, no greater than 20%, no greater than 15%, no greater than 10%, no greater than 5%, or none of the T21 biomarkers in a sample expression profile from the subject's biological sample show altered expression when compared to those T21 biomarkers in a control expression profile from another healthy subject. For instance, in an embodiment where 10 biomarkers are measured in a biological sample from a subject, such as a pregnant mother carrying a normal fetus, the subject may be considered to have a normal fetus when no more than 4 of the biomarkers in a sample expression profile show altered expression when compared to the normal range for the population of healthy fetuses.

Whether the expression level or quantity of a biomarker in a subject having T21 is greater than or less than the expression level or quantity of the biomarker in a healthy subject is determined using routine statistical methods by applying accepted confidence levels. The expression level or quantity of a T21 biomarker in a biological sample is considered to be altered if the difference in amount of the biomarker in a test sample is increased or decreased to a statistically significant degree compared to the amount of the biomarker in a control sample. The term "statistically significant" refers to a result, namely a difference in numbers of positive results between a test and a control that is not likely due to chance. The minimum chance level for statistical significance herein is 95% probability that the result is not due to chance, i.e., random variations in the data. A 95% confidence interval means that if the procedure for computing a 95% confidence interval is used over and over, 95% of the time the interval will contain the true parameter value. In one embodiment, the minimum chance level for statistical significance is 97% probability, 99% probability, or 99.9% probability. Various methods, as is known, can be used to calculate statistical significance. Examples include, but are not limited to, binomial probabilities, the Poisson distribution, chi-square, and t-test. The skilled person will recognize that one may use sufficient numbers of results to obtain a confidence interval of at least 95%, or higher, in order to determine statistical significance of a difference in expression level or quantity of a biomarker in a subject having T21 and the expression level or quantity of the biomarker in a healthy subject. However, machine learning protocols can be utilized to recognize patterns with ranking in order to determine if there is a significance of a difference in expression level or quantity of biomarker in a subject having T21 from the expression level or quantity of the biomarker in the health subject.

In one embodiment, a subject is considered to have T21 when comparison of expression of at least one T21 biomarker, or a plurality of T21 biomarkers, with the expression level of the at least one T21 biomarker, or a plurality of T21 biomarkers, in a biological sample from a subject not having T21 shows a difference, and that difference is indicative of the presence of T21 in the subject. In one embodiment, a subject is considered to have T21 when expression of at least one T21 biomarker, or a plurality of T21 biomarkers, is altered to a statistically significant degree or determined by machine learning in a biological sample from the subject compared to a biological sample from a subject not having trisomy 21. In one embodiment, a subject is considered to have T21 when comparison of expression of at least one T21 biomarker with the expression level of the at least one T21 biomarker in a biological sample from a subject not having T21 shows that the expression level or quantity of a biomarker in the subject is outside the 95% confidence interval for the biomarker. In one embodiment, a subject is considered to have T21 when comparison of expression of a plurality of T21 biomarkers with the expression level of the plurality of T21 biomarkers in a biological sample from a subject not having T21 shows that the expression level or quantity of the plurality of biomarker in the subject is outside the 95% confidence interval for the plurality of the biomarkers.

Accordingly, in one embodiment, a method provided herein includes measuring a plurality of T21 biomarkers in a biological sample obtained from a subject, such as a pregnant female. The plurality of T21 biomarkers (e.g., a specific combination) measured may be selected from any combination of a defined group, or a complement thereof, or a portion thereof. The plurality of T21 biomarkers measured may be polynucleotides that hybridize to a sequence selected from any one of SEQ ID NO:8-3,273 under suitable conditions. In one embodiment, a method provided herein includes detecting T21 biomarkers in a biological sample to yield an expression level of each detected T21 biomarker. The T21 biomarkers may be selected from any combination of SEQ ID NO:8-3,273, or a complement thereof, or a portion thereof. The T21 biomarkers detected may be polynucleotides that hybridize to a sequence selected from any one of SEQ ID NO:8-3,273 under suitable conditions. The biological sample may include plasma from a pregnant female. In one embodiment, a method disclosed herein includes detecting T21 biomarkers in a biological sample to yield a sample expression profile. The T21 biomarkers may be selected from any combination of SEQ ID NO:8-3,273, or a complement thereof, or a portion thereof. The T21 biomarkers detected may be selected from SEQ ID NO:8-3,273, or a complement thereof, or a portion thereof. The T21 biomarkers detected may be polynucleotides that hybridize to a sequence selected from any one of SEQ ID NO:8-3,273 under suitable conditions. The biological sample may include plasma from a pregnant female.

In one embodiment, such as one where the subject is a pregnant female, a method disclosed herein may include identifying the fetus as i) having trisomy 21 if expression of the plurality of biomarkers is altered to a statistically significant degree in the biological sample compared to a biological sample from a second pregnant female carrying a fetus not having trisomy 21, or ii) not having trisomy 21 if expression of the plurality of biomarkers is not altered to a statistically significant degree in the biological sample compared to a biological sample from a second pregnant female carrying a fetus not having trisomy 21. In one embodiment, such as one where the subject is a pregnant female, the method may further include comparing the expression level of a detected T21 biomarker to the expression level of the T21 biomarker in pregnant females carrying a fetus without T21, wherein an expression level of a detected T21 biomarker that is outside the 95% confidence interval for that T21 biomarker indicates the expression level of the T21 biomarker is altered. In one embodiment, such as one where the subject is a pregnant female, the method may further include comparing the sample expression profile with a reference expression profile; wherein a difference between the sample expression profile and the reference expression profile is indicative of the presence of trisomy 21 in the fetus. A sample whose expression levels were not different from the standard control would be interpreted to be from a pregnancy unaffected by T21. A significant difference from the standard would lead to the conclusion T21 was present]

In one embodiment, such as one where the fetus is diagnosed as having T21, a method may further include recommending to the pregnant female a genetic test chosen from amniocentesis, cordocentesis, and chorionic villus sampling.

Amounts of T21 biomarkers in a biological sample may be determined in absolute or relative terms. If expressed in relative terms, amounts can be expressed as normalized amounts with reference to one or more normalization sequences present in a biological sample.

It is expected that this method will have a sensitivity (percent of fetuses or subjects having T21 correctly identified, also referred to as detection rate) of at least 98%, at least 99%, or 100% when enough T21 biomarkers present in a biological sample are detected. It is also expected that this method will have a specificity (percent of fetuses or subjects not having T21 correctly identified) of at least 98%, at least 99%, or 100% when enough T21 biomarkers present in a biological sample are detected.

Measuring the expression level or quantity of any single T21 biomarker or a plurality of T21 biomarkers may be accomplished by use of techniques that are known in the art and routine. In one embodiment, the expression level or quantity of a T21 biomarker or a plurality of T21 biomarkers may be monitored directly by detecting RNA present in a biological sample. RNA may be obtained from a biological sample using routine techniques known in the art. In one embodiment, the RNA is cell-free RNA obtained from biological tissue and/or fluid. In one embodiment, the RNA is cell-free plasma RNA obtained from whole blood, blood plasma, or serum. In one embodiment, the RNA is isolated. As used herein, the term "isolated" refers to a polynucleotide that has been removed from its natural environment.

Detecting one or more T21 biomarkers that are present as a RNA polynucleotide may be accomplished by a variety of methods. Some methods are quantitative and allow estimation of the original levels of RNA between the levels present in a test sample and a control, such as a control expression level for a T21 biomarker and/or a control expression profile, whereas other methods are merely qualitative. In one embodiment, a method for detecting one or more T21 biomarkers may include the use of polynucleotides that are in solution, and may be in any format, including, but not limited to, the use of individual tubes or a high throughput device, such as a PCR-card.

Quantitative real-time PCR (QRT-PCR) may be used to measure the differential expression of any T21 biomarker in a test sample and a control. In QRT-PCR, the RNA template is generally reverse transcribed into cDNA, which is then amplified via a PCR reaction. The primers used for amplification may be selected by determining which T21 biomarker(s) described at SEQ ID NO:8-3,273 is to be amplified, and then designing primers using routine methods known in the art. The PCR amplification process is catalyzed by a thermostable DNA polymerase. Non-limiting examples of suitable thermostable DNA polymerases include Taq DNA polymerase, Pfu DNA polymerase, Tli (also known as Vent) DNA polymerase, Tfl DNA polymerase, and Tth DNA polymerase. The PCR process may include three steps (i.e., denaturation, annealing, and extension) or two steps (i.e., denaturation and annealing/extension). The temperature of the annealing or annealing/extension step may vary, depending upon the amplification primers and other parameters such as concentration. The temperature of the annealing or annealing/extending step may range from about 50° C. to about 75° C. The amount of PCR product is followed cycle-by-cycle in real time, which allows for determination of the initial concentrations of mRNA. The reaction may be performed in the presence of a dye that binds to double-stranded DNA, such as SYBR Green. The reaction may also be performed with fluorescent reporter probes, such as TAQMAN probes (Applied Biosystems, Foster City, Calif.) that fluoresce when the quencher is removed during the PCR extension cycle. Fluorescence values are recorded during each cycle and represent the amount of product amplified to that point in the amplification reaction. The cycle when the fluorescent signal is first recorded as statistically significant is the threshold cycle (Ct). To minimize errors and reduce any sample-to-sample variation, QRT-PCR is typically performed using one or more normalization sequences.

Reverse-transcriptase PCR (RT-PCR) may also be used to measure the expression of a T21 biomarker. As described above, the RNA template is reverse transcribed into cDNA, which is then amplified via a typical PCR reaction. After a set number of cycles the amplified DNA products are typically separated by gel electrophoresis. Comparison of the relative amount of PCR product amplified in different samples will reveal whether the expression of a T21 biomarker is altered in a test sample. Accordingly, sequences in the Sequence Listing showing DNA can have the "T" replaced with a "U" to convert to the corresponding RNA, and vice versa.

Expression of a T21 biomarker may also be measured using a nucleic acid microarray (also referred to in the art as a DNA chip or biochip). In this method, single-stranded polynucleotides selected from at least a portion of SEQ ID NO:8-3,273, or a complement thereof, are plated, or arrayed, on a solid support. The solid support may be a material such as, for instance, glass, silica-based, silicon-based, a synthetic polymer, a biological polymer, a copolymer, a metal, or a membrane. The form or shape of the solid support may vary, depending on the application. Suitable examples include, but are not limited to, slides, strips, plates, wells, microparticles, fibers (such as optical fibers), gels, and combinations thereof. The arrayed immobilized sequences are generally hybridized with specific DNA probes obtained from the test sample. As described above, RNA present in a sample, including T21 biomarkers, is generally reverse transcribed into cDNA. Fluorescently labeled cDNA probes may be generated through incorporation of fluorescently labeled deoxynucleotides during the reverse transcription step. The cDNA probes are hybridized to the immobilized nucleic acids on the solid support under highly stringent conditions. After stringent washing to remove non-specifically bound probes, the solid support is scanned using routine methods, for instance, by confocal laser microscopy or by another detection method, such as a CCD camera. Quantitation of hybridization of each arrayed element allows for assessment of corresponding RNA abundance. With multiple color fluorescence, separately labeled cDNA probes may be hybridized pairwise to the array. The relative abundance of the transcripts from the two sources corresponding to each specified T21 biomarker may then be determined simultaneously. Microarray analysis may be performed by commercially available equipment, following manufacturer's protocols, such as by using the Affymetrix GenChip technology, or Incyte's microarray technology.

Differential expression of a T21 biomarker may also be measured using Northern blotting. For this, RNA samples are first separated by size via electrophoresis in an agarose gel under denaturing conditions. The RNA is then transferred to a membrane, crosslinked, and hybridized, under highly stringent conditions, to a labeled DNA probe. After washing to remove the non-specifically bound probe, the hybridized labeled species are detected using routine techniques known in the art. The probe may be labeled with, for instance, a radioactive element, a chemical that fluoresces when exposed to ultraviolet light, a tag that is detected with an antibody, or an enzyme that catalyses the formation of a colored or a fluorescent product. A comparison of the relative amounts of RNA detected in a control sample and a test sample will reveal whether the expression of one or more T21 biomarkers or changed in the test sample.

Nuclease protection assays may also be used to monitor the altered expression of a T21 biomarker in a test sample and a control. In nuclease protection assays, an antisense probe hybridizes in solution to a RNA sample. The antisense probe may be labeled with an isotope, a fluorophore, an enzyme, or another tag. Following hybridization, nucleases are added to degrade the single-stranded, unhybridized probe and RNA. An acrylamide gel is used to separate the remaining protected double-stranded fragments, which are then detected using techniques well known in the art. Again, qualitative differences in expression may be detected.

In one embodiment, expression of a T21 biomarker may be examined in vivo in a subject. One or more RNA polynucleotides may be labeled with fluorescent dye, a bioluminescent marker, a fluorescent semiconductor nanocrystal, or a short-lived radioisotope, and then the subject may be imaged or scanned using a variety of techniques, depending upon the type of label.

In one embodiment, the detection of a RNA, such as a CFP RNA, uses the nucleotides of a specific exon as described in SEQ ID NO:8-3,273. Thus, if QRT-PCR is used to detect a specific CFP RNA, the primers used to amplify the CFP RNA will amplify all or a portion of an exon described in SEQ ID NO:8-3,273. If a microarray is used to detect a specific CFP RNA, the arrayed immobilized sequence used to detect the CFP RNA will be based on all or a portion of an exon described in SEQ ID NO:8-3,273, or a complement thereof. A person skilled in the art will know which parameters may be manipulated to optimize detection of a RNA of interest using one or more of the polynucleotides listed at SEQ ID NO:8-3,273.

When determining whether the expression of a T21 biomarker or a plurality of T21 biomarkers are altered in a test sample compared to a control expression level or a control expression profile, it can be helpful to use a normalization sequence. A normalization sequence is a polynucleotide that can be used to normalize the relative amounts of polynucleotides, and/or data obtained from the polynucleotides, from one sample to the next. A normalization sequence can be RNA that has an expression level or quantity that is generally stable under the conditions studied. That is, the normalization sequence can have an expression level or quantity that is substantially unaffected by physiological circumstances present in a subject, and thus the normalization sequence can be used to normalize the amount of polynucleotides in separate samples for comparison. The separate samples can be from different subjects or the same subject at different time points, such as different time points in pregnancy. For example, the normalization sequence can be used to normalize the amount of RNA in QRT-PCR studies, such as by normalizing the amount of a RNA sequence of interest. The normalization sequences described herein can be used alone or in combination and may be used to normalize samples to be assayed for T21 biomarkers. Thus, the normalization sequences provided herein can be for quantification of cell-free RNA, including CFP RNA, present in a biological sample.

It has been determined that previously reported normalization sequences utilized in other tissues for quantification of isolated RNA (e.g., mRNA: 18s RNA, RPLP0, and GAPDH; miRNA: miR-103, miR-146a, and miR-197) were either expressed inconsistently in control plasma samples or were altered by either pregnancy, gestational age or disease (see Dong and Weiner, WO 12/075150, incorporated by reference). The normalization sequences described can include cell-free plasma RNA sequences (including coding sequences, e.g., mRNA, and/or non-coding sequences, e.g., miRNA) that are substantially unchanged by a condition. In one embodiment, the normalization sequences are substantially unchanged during the course of pregnancy.

Normalization sequences appropriate for use in the methods provided herein may be identified as described in Dong and Weiner (WO 12/075150, incorporated by reference). In one embodiment, the normalization sequence includes a circulating RNA. Such a normalization sequence can be described as human (i.e., *Homo sapiens*) peptidylprolyl isomerase A (i.e., cyclophilin A, rotmase A), which is encoded by a PPIA coding region. The normalization sequence can be an mRNA for peptidylprolyl isomerase. An example of a peptidylprolyl isomerase normalization sequence can be found at accession number: NM_021130 and/or NM_001008741. An example of a peptidylprolyl isomerase normalization sequence that may be useful for normalization of mRNA is depicted at SEQ ID NO: 1 (see FIG. 1). In one embodiment, the normalization sequence may include miRNA. Such a normalization sequence may be a *Drosophila melanogaster* small nuclear RNA, such as snRNA:U6. The snRNA:U6 normalization sequence can be snRNA:U6 at 96Aa, 96:Ab, and/or 96Ac. Examples of these normalization sequences include snRNA:U6:96Aa (SEQ ID NO: 2 for miRNA), snRNA:U6:96Ab (SEQ ID NO: 3 for miRNA), and/or snRNA:U6:96Ac (SEQ ID NO: 4 for miRNA) (see FIG. 1), and can be found at the following accession numbers, respectively: NR_002081 (snRNA:U6:96Aa); NR_002082 (snRNA:U6:96Ab); and NR_002083 (snRNA:U6:96Ac). Accordingly, SEQ ID NO:1 may be used for normalization of mRNA, and SEQ ID NOs: 2-4 may be used for normalization of miRNA. More than one normalization sequence may be used.

Primers and probes for these sequences can be readily obtained by one of ordinary skill in the art. For example, sequences for the forward primer, reverse primer, and probe for SEQ ID NO:1 (e.g., for an mRNA normalization sequence) may be: Forward primer: GCTTTGGGTCCAGGAATGG (SEQ ID NO:5); Reverse primer: GTTGTCCACAGTCAGCAATGGT (SEQ ID NO:6); and Probe: AGACCAGCAAGAAGAT (SEQ ID NO:7). These polynucleotides may also be used as normalization sequences in the methods provided herein.

In one embodiment, a normalization sequence may be a polynucleotide that contains or consists of the sequence. The normalization sequence can be identical to one of SEQ ID NO:1-7, or can be a complement thereof, sense or antisense, as well as a sequence that hybridizes therewith under suitable conditions. In one embodiment, a normalization sequence may include a sequence selected from SEQ ID NO:1-7, or the complement thereof, that is at least 15 nucleotides, at least 20 nucleotides, at least 25 nucleotides, at least 30 nucleotides, at least 35 nucleotides, at least 40 nucleotides, at least 45 nucleotides, at least 50 nucleotides, or at least 55 nucleotides, to the full sequence. In one embodiment, the normalization sequence can include a sequence of SEQ ID NO:1, 2, 3, 4, 5, 6, or 7. A normalization sequence may have perfect identity, at least 95% identity, at least 90% identity, at least 85% identity, or at least 80% identity with a sequence selected from SEQ ID NO:1-7. A normalization sequence may have perfect complementarity or at least 95% complementarity, at least 90% complementarity, at least 85% complementarity, or at least 80% complementarity with a sequence selected from SEQ ID NO:1-7. A normalization sequence may be continuous or it can have one or more bulges or mismatches upon hybridization. A normalization sequence may also include one or more chemical modifications, such as a 2' carbon modification. A normalization sequence may or may not form an overhang upon hybridization when detecting a RNA present in a biological sample.

Provided herein is an article that includes a substrate and a plurality of individual polynucleotides. The individual polynucleotides may be selected from SEQ ID NO:8-3,273, or a complement thereof, or a portion thereof. The polynucleotides are immobilized onto a surface of the substrate. In one embodiment, the polynucleotides are immobilized on the substrate surface to form a microarray.

Provided herein are kits. A kit may include one or more polynucleotides for measuring the expression of at least one T21 biomarker, wherein alteration in the expression of the one or more T21 biomarkers in a subject relative to a control is indicative of the presence, absence, or type of T21. A kit may include one or more polynucleotides that are specific to a selected T21 biomarker A polynucleotide present in a kit may have a sequence that is identical to a polynucleotide listed at SEQ ID NO:8-3,273, or the complement thereof. In one embodiment, polynucleotide present in a kit may have a portion of a sequence that is identical to a polynucleotide listed at SEQ ID NO:8-3,273, or the complement thereof. The polynucleotides to be used in the measurement of the expression of one or more T21 biomarkers can, depending upon the type of technique to be used. For example, the kit may include polynucleotides useful as primers for QRT-PCR. Polynucleotides useful as probes may be included in a kit and are optionally provided together with a solid substrate, such as but not limited to a bead, a chip, a plate, and a microarray. Polynucleotides may be immobilized on the surface of such a substrate. A kit may also further include a reverse transcriptase, a thermostable DNA polymerase, appropriate buffers and salts, or the combination thereof.

Additional reagents useful in the methods described herein, for example determining the presence, absence, or type of T21 in a subject, may be provided in a kit. Depending on the technique or procedure, the kit may further include one or more additional reagents such as, but not limited to, buffers such as amplification buffers, hybridization buffers, labeling buffers, or any equivalent reagent. Reagents may be supplied in solid (e.g., lyophilized) or liquid form, and these may optionally be provided in individual packages using containers such as vials, packets, bottles and the like, for each individual reagent. Each component can for example be provided in an amount appropriate for direct use or may be provided in a reduced or concentrated form that can be reconstituted.

A kit may further include materials and tools useful for carrying out methods described herein. A kit can be used for example in diagnostic laboratories, clinical settings, or research settings. The kit may further include instructions for use, including for example any procedural protocols and instructions for using the various reagents in the kit for performing different steps of the process. Instructions for using the kit according to one or more methods of the invention may include instructions for processing a biological sample obtained from a subject and/or for performing the test, and instructions for analyzing or interpreting the results. Instructions may be provided in printed form or stored on any computer readable medium including but not limited to DVDs, CDs, hard disk drives, magnetic tape and servers capable of communicating over computer networks. A kit may further include one or more normalization sequences.

It will be understood that generally, components of a kit are conveniently packaged or bound together for ease of handling in commercial distribution and sale.

Combinations of Nucleic Acid Biomarkers

In some embodiments, a method of detecting a combination of nucleic acid biomarkers in a human subject can include: obtaining a nucleic acid sample from the human subject; selecting the combination of nucleic acid biomarkers; analyzing a transcriptome of the human subject for the combination of nucleic acid biomarkers in the nucleic acid sample from the human subject; detecting in the nucleic acid sample the presence of the combination of nucleic acid biomarkers, wherein each nucleic acid biomarker in the combination of nucleic acid biomarkers has a variation from a transcription standard.

In some embodiments, the method includes providing the transcription standard for each nucleic acid biomarker for the combination of nucleic acid biomarkers.

In some embodiments, the method includes providing the combination of nucleic acid biomarkers as a set of primers and/or probes.

In some embodiments, the method includes obtaining cell free plasma RNA as the nucleic acid sample. In some embodiments, the nucleic acid biomarkers are RNA.

In some embodiments, the method can include generating a report, the report reciting the presence of the combination of nucleic acid biomarkers being present in the nucleic acid sample of the human subject being present in a biomarker amount that is varied from the transcription standard.

In one embodiment, a kit includes purified or isolated nucleic acids, wherein the nucleic acids have the sequences of each of the nucleic acid biomarkers in the combination of biomarkers. As such, each recited combination can be uniquely included in a kit. In some aspects, the nucleic acid biomarkers are attached to a substrate of a biochip, where each nucleic acid biomarker can be in a unique position or a position can include one or more of the nucleic acid biomarkers of the combination.

As used herein, "nucleic acid biomarker" or "biomarker" is defined to be a nucleic acid, such as an RNA, that is present in an abnormal amount compared to a standard or normal amount. The biomarker thereby then serves as a tool to look for changes in the transcription thereof. For example, a biomarker can be present at a normal or standard level when there is no disease state or susceptibility of a disease state, but the biomarker is present at a changed level or a variation from the standard or normal amount. While SNPs may be detected by merely identifying the presence, the nucleic acid biomarkers described herein may always be present, but the change in the transcription thereof or change in the amount or concentration in blood or plasma provides the indication that the subject may have a condition that is marked by the biomarker. Thus, by using the term "biomarker" it is clear that the transcription thereof, amount thereof or concentration thereof is not normal, such that it is changed. Such a changed condition can be compared to subject (e.g., pregnant woman, fetus possibly having T21 whether known or unknown) prior to pregnancy or in early pregnancy (e.g., earlier than 12 weeks or between 16-20 weeks). Thus, by being defined as a biomarker, it is defined that the transcription thereof, amount thereof or concentration thereof is detectably different from a standard or normal person without the condition or the same subject prior to onset of the condition—T21 in the fetus. In some aspects, a biomarker requires at least a fold change relative to the normal or standard amount or concentration or transcription, or at least a 1.3 fold change, or at least a 1.4 fold change, or at last a 1.5 fold change, or at least a 1.6 fold change, or at least a 1.7 fold change, whether the change is up regulation (increased transcription, amount or concentration) or down regulation (decreased transcription, amount or concentration) compared to a standard or normal amount or compared to that of the subject prior to being pregnant or prior to 9 weeks or prior to 12 weeks of gestation (or prior to 7 weeks or prior to 10 weeks implantation).

As used herein, "combination of biomarkers" or "combination of nucleic biomarkers" defines a unique combination of nucleic acids that are biomarkers under the definition of a biomarker provided herein. The combination of biomarkers provides an indication of a T21 disease state in a fetus of a pregnant woman.

The combination of biomarkers can be detected to be present in a biomarker amount by hybridizing the biomarker with a biomarker primer (PCR) or biomarker probe (biochip). The combination of biomarkers can be calculated or quantitated with a normalization nucleic acid during the detection of the biomarker amount thereof. The combination of biomarkers can be tied to a disease state—T21 of a fetus. Once the disease state is identified for the combination of biomarkers, a treatment regimen can be provided to the subject, such as pregnant woman or the fetus thereof, that has the biomarker amount. In one aspect, a further confirmatory diagnostic protocol can be performed to confirm T21. The treatment regimen can then be implemented on the pregnant woman, such as providing a report with the information of abortion as an option or choosing to end the pregnancy. The combination of biomarkers can be present as a kit in the combination. The kit may include instructions identifying the combination of biomarkers and the indication of the disease state thereof.

Transcriptome-typing can be performed with the combination of biomarkers. Transcriptome-typing is equivalent to genotyping for transcribed RNA.

A method for detecting T21 in an asymptomatic subject comprising: (a) subjecting a sample from the subject to a procedure to detect polynucleotides (biomarkers) of specific Groups; (b) detecting T21 by comparing the amount of polynucleotides in a specific biomarker group to the amount of such polynucleotides obtained from a control who does not have T21 wherein the polynucleotides comprise at least one of, or are selected from Group 1, 2, 3, 4, 5, or combination groups thereof, or any other combination of groups described herein.

A method where the procedure comprises detecting Groups of polynucleotides in the sample by contacting the sample with oligonucleotides that hybridize to the polynucleotides (biomarkers); and detecting in the sample levels of nucleic acids that hybridize to the polynucleotides relative to a control, wherein a change or significant difference in the amount or status of the polynucleotides in the sample compared with the amount or status in the control is indicative of T21.

A method wherein the procedure comprises: contacting the sample with the group of biomarkers that specifically bind to the polynucleotides under conditions effective to bind the biomarkers and form complexes; measuring the amount or status of the polynucleotides present in the sample by quantitating the amount of the complexes; and wherein a change or significant difference in the amount or status of polynucleotides in the sample compared with the amount or status obtained from a control subject who does not suffer from T21 is indicative of T21. Within certain embodiments, the amount of polynucleotides that are RNA are detected via polymerase chain reaction using, for example, oligonucleotide primers that hybridize to one or more combinations of biomarkers, or complements of such combinations of biomarkers.

Within other embodiments, the amount of RNA is detected using a hybridization technique, employing oligonucleotide probes that hybridize to one or more combinations of biomarkers, or complements thereof.

Figure 6:
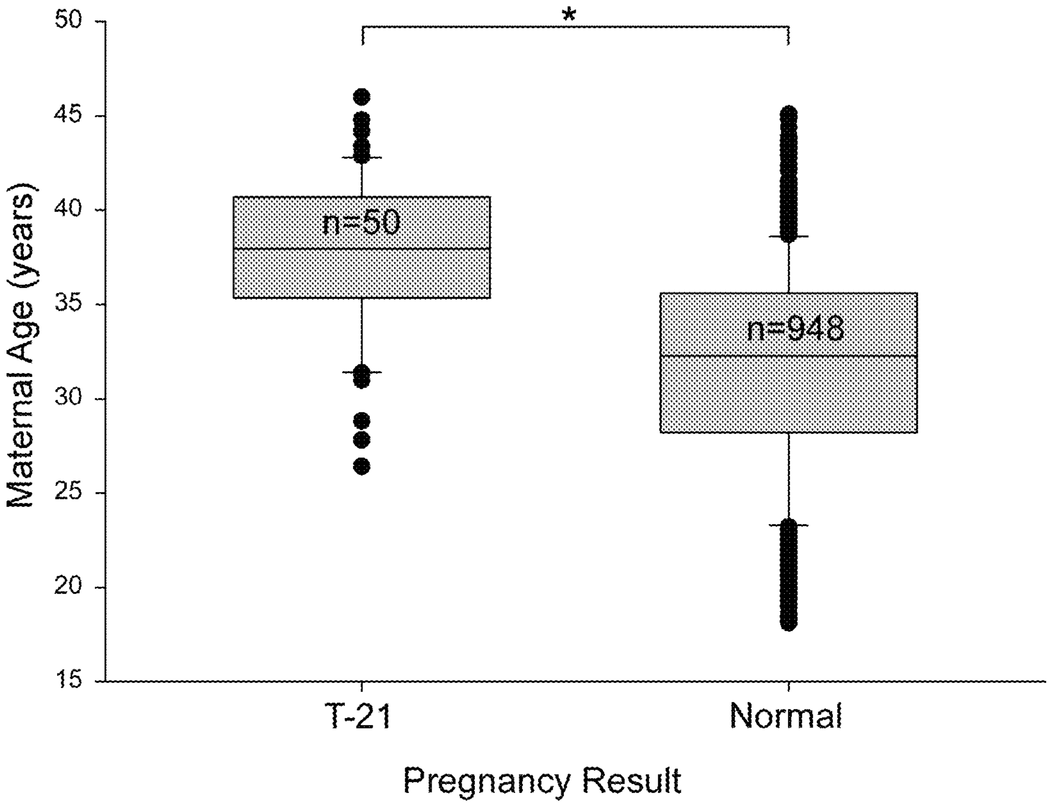

FIG. 6 shows that the maternal age in Normal (euploid fetus) women and those with a Trisomy 21 fetus. The box illustrates the median and the 25th-75 percentile range. The solid circles show the number of women whose age was above the 90th or below the 10th percentile. This data illustrates the well-known increase in Trisomy 21 prevalence with advancing maternal age.

Figure 7A:
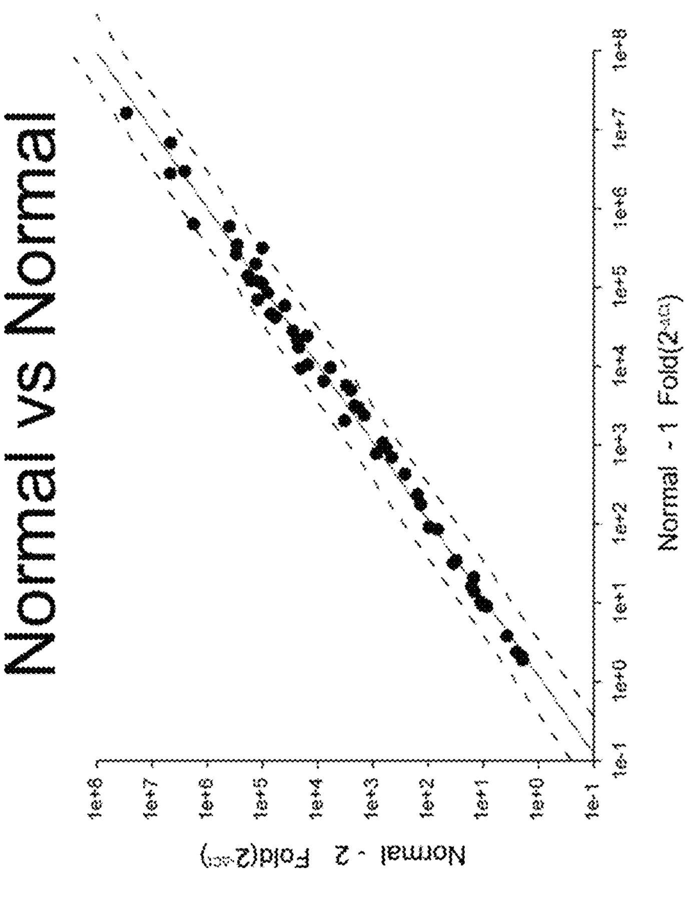
FIG. 7A shows the Mean RNA expression of a 54 cell free RNAs subset (Group).
Figure 7B:
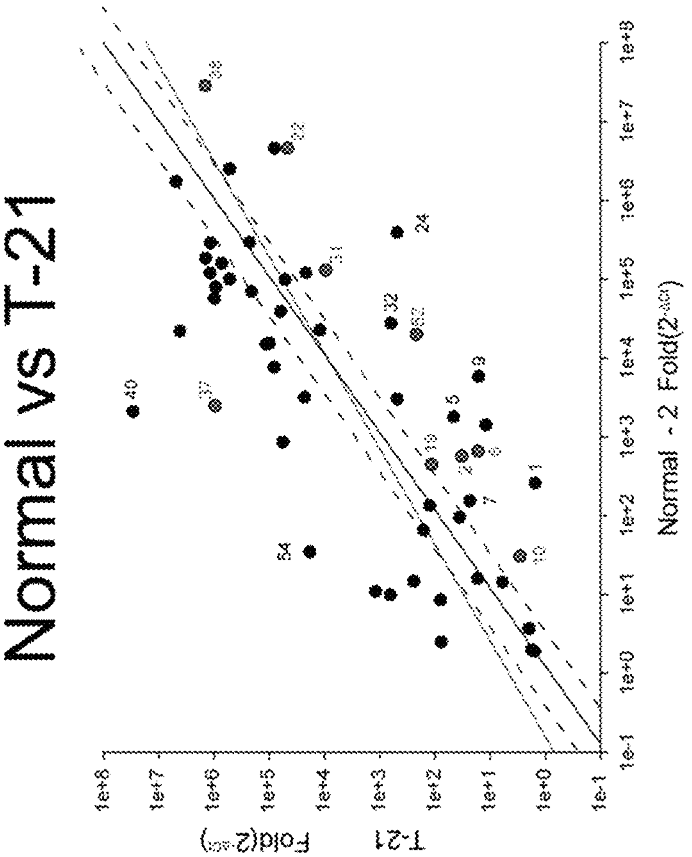
FIG. 7B shows the Mean RNA expression for the group of 54 cell free RNA markers for the Trisomy 21 (n=50) (Y axis) plotted against mean expression of the same marker in the Normal subjects (n=948).
Figure 8C:
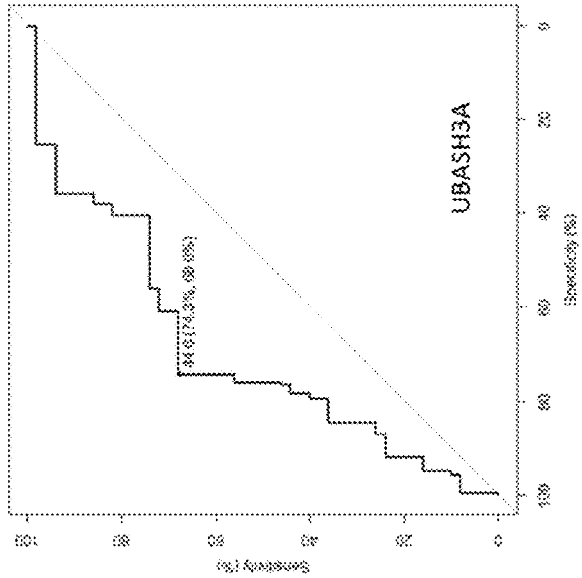
FIGS. 8A-8I show the ROCs for the 9 RNAs shown by the light dots in FIG. 7B with the highest p values.
Figure 8B:
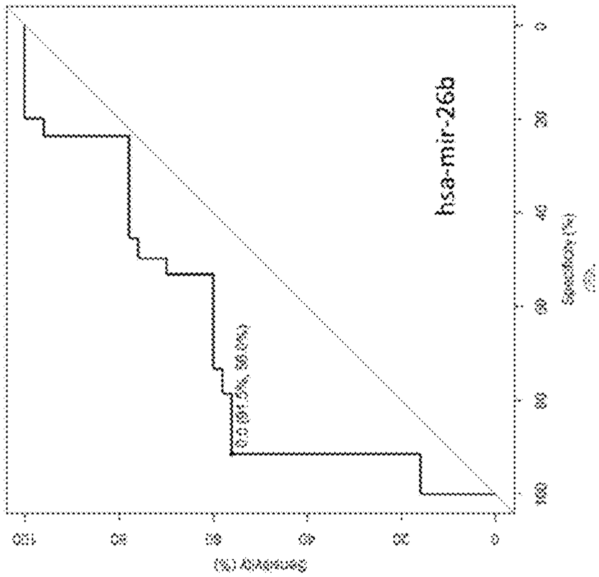
Figure 8A:
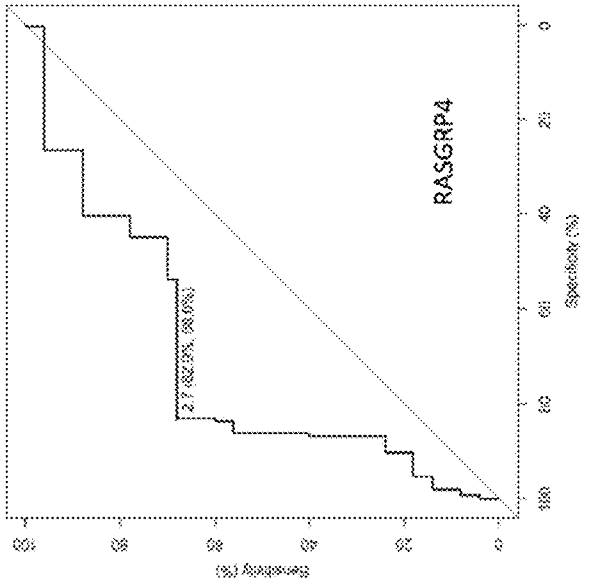
Figure 8F:
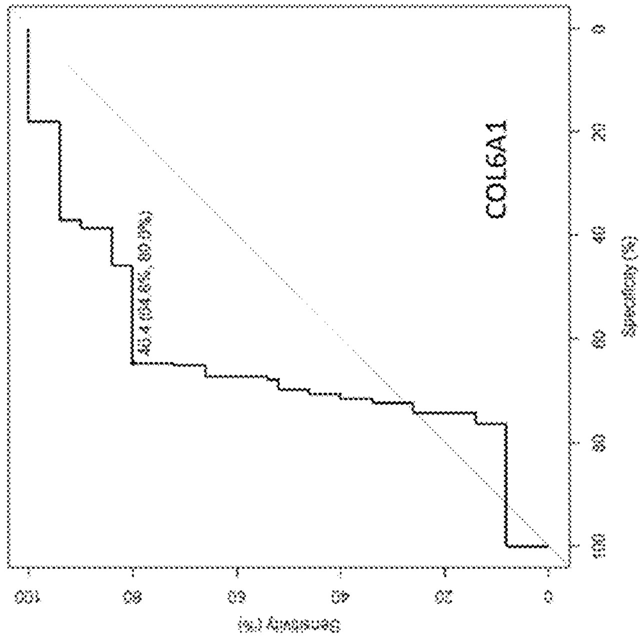
Figure 8E:
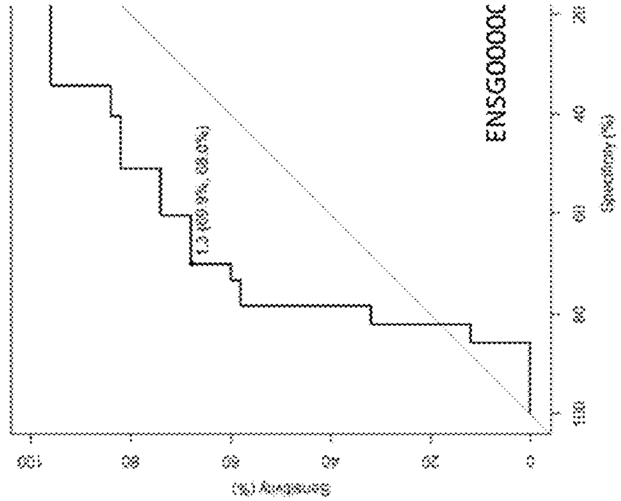
Figure 8D:
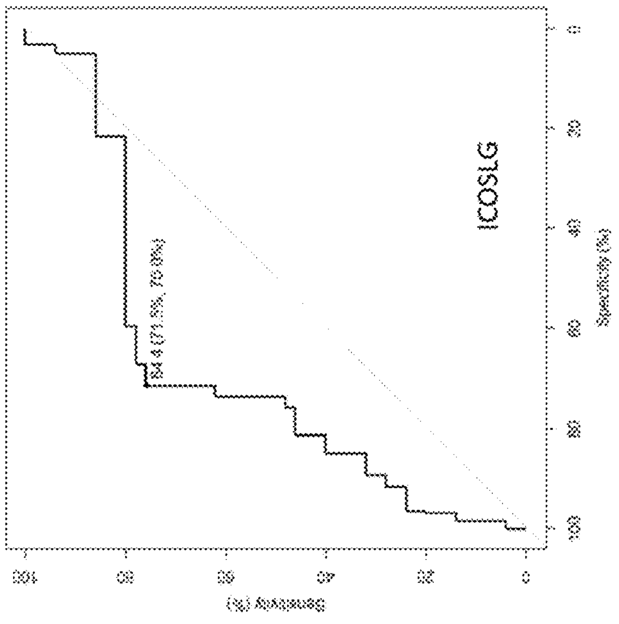
Figure 8G:
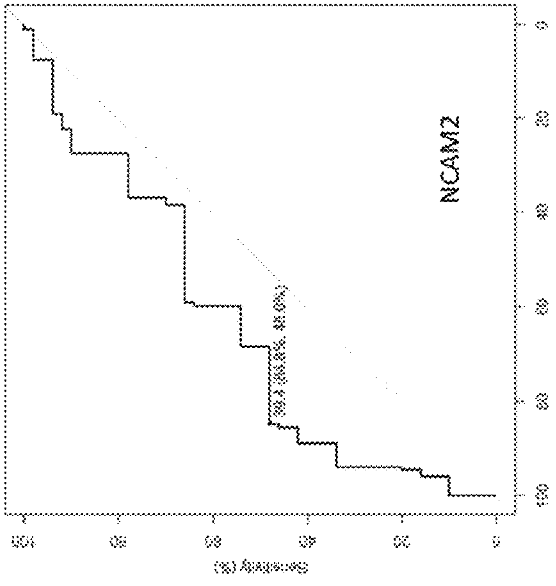
Figure 8H:
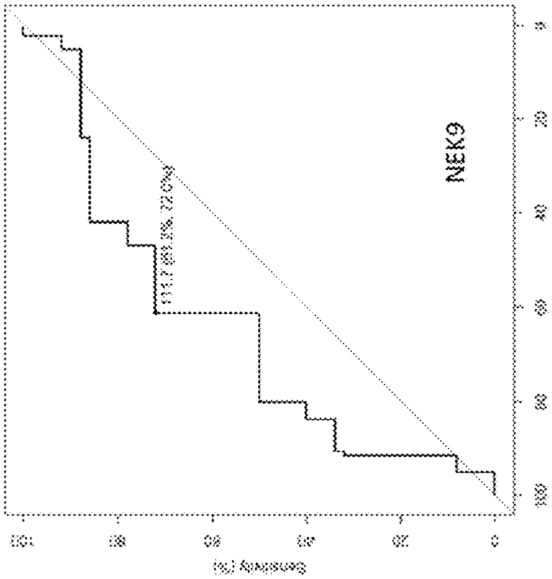
Figure 8I:
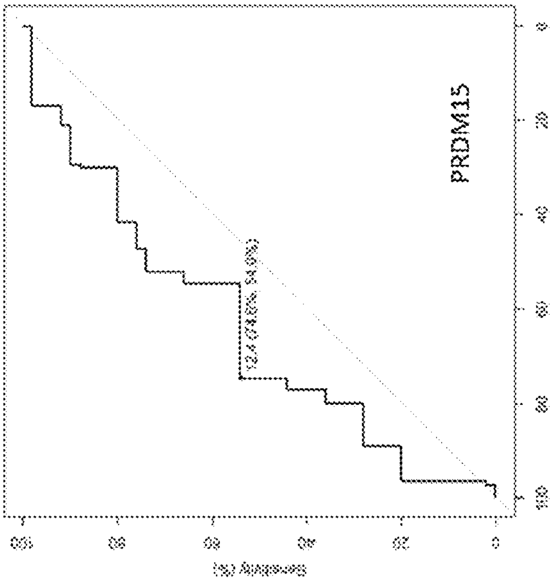

FIGS. 7A-7B show that the protocols provide for high reproducibility of the high throughput assay that is utilized for gene quantification and the differential plasma cell free RNA expression in women with a Trisomy 21 fetus. FIG. 7A shows the Mean RNA expression of a 54 cell free RNAs subset (Group) from the original list of 3,248 plasma cell free RNA markers. This group of 54 cell free RNAs is selected because they had the highest differential expression half in women with a Trisomy 21 fetus. One half of the Normal subjects were selected at random and mean expression for each RNA marker was plotted against the mean expression of the same marker in the second half of Normal women. The solid line represents the correlation between the two groups. FIG. 7B shows the Mean RNA expression for the group of 54 RNA markers for the Trisomy 21 (n=50) (Y axis) plotted against mean expression of the same marker in the Normal subjects (n=948). The light dots identify the 10 variables with the highest p values for differential expression in women with a Trisomy 21 fetus by Mann Whitney U test after adjustment by a Bonferroni correction. The solid line between the dashed lines represents the correlation illustrated on the right, while the solid line that crosses the dashed lines is the correlation between the T21 and Normal groups. Notice the change in slope, which indicates the change obtained with the selected group of 54 cell free RNAs.

FIGS. 8A-8I show the ROCs for the 9 RNAs shown by the light dots in FIG. 7B with the highest p values. These are a specific subset grouping of the cell free RNAs.

Figure 9:
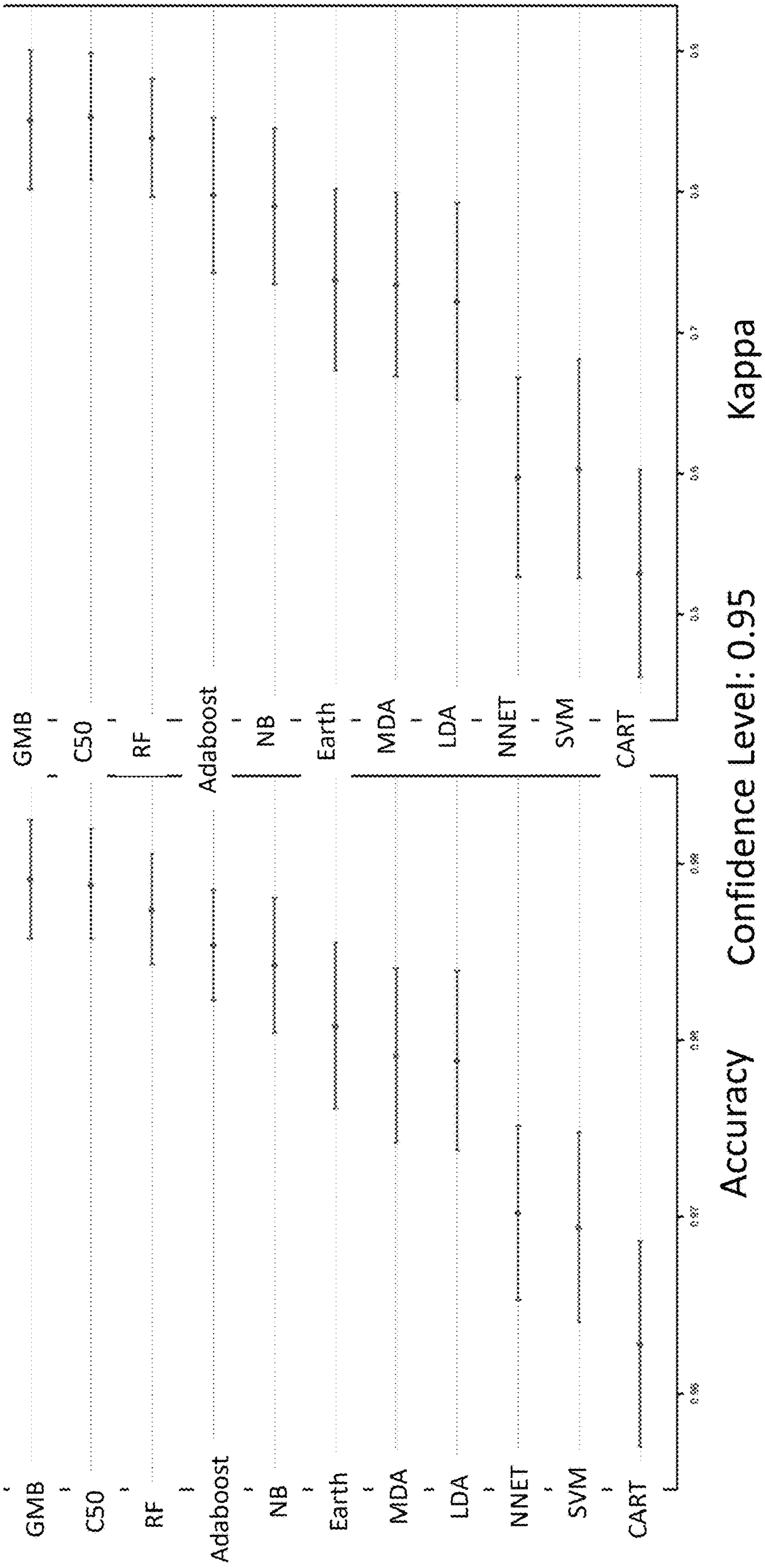

FIG. 9 shows a comparison of 11 Machine Learning (ML) algorithms: Gradient Boosting Machine (GBM), C5.0, Random Forest (FR), Adaboost, Naïve Bayesian (NB), Earth, Mean Decrease in Accuracy (MDA), linear discriminant analysis (LDA), Neural Network (NNET), Support Vector Machine (SVM), and Classification and Regression Trees (CART). GBM and C5.0 proved superior for the detection of Trisomy 21 fetuses with RF close behind using all 54 plasma cell free RNA markers in terms of accuracy and Kappa. These studies support the grouping of the 54 RNA markers.

Figure 10:
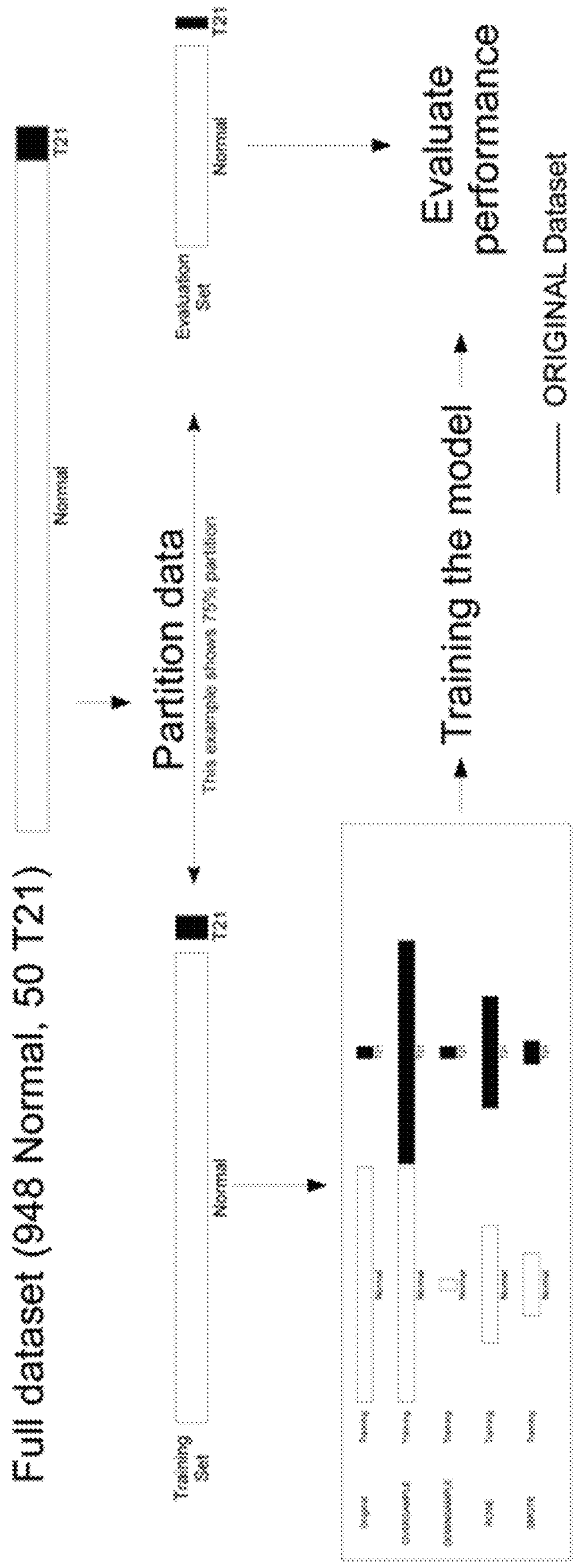

FIG. 10 shows general workflow that leads to the identification of the biomarker subsets that are described herein. The workflow uses artificial intelligence to select the biomarker groups described herein, and the selected biomarker groups can be used in the multiple models in order to identify women whose fetus had/have Trisomy 21.

Figure 11:
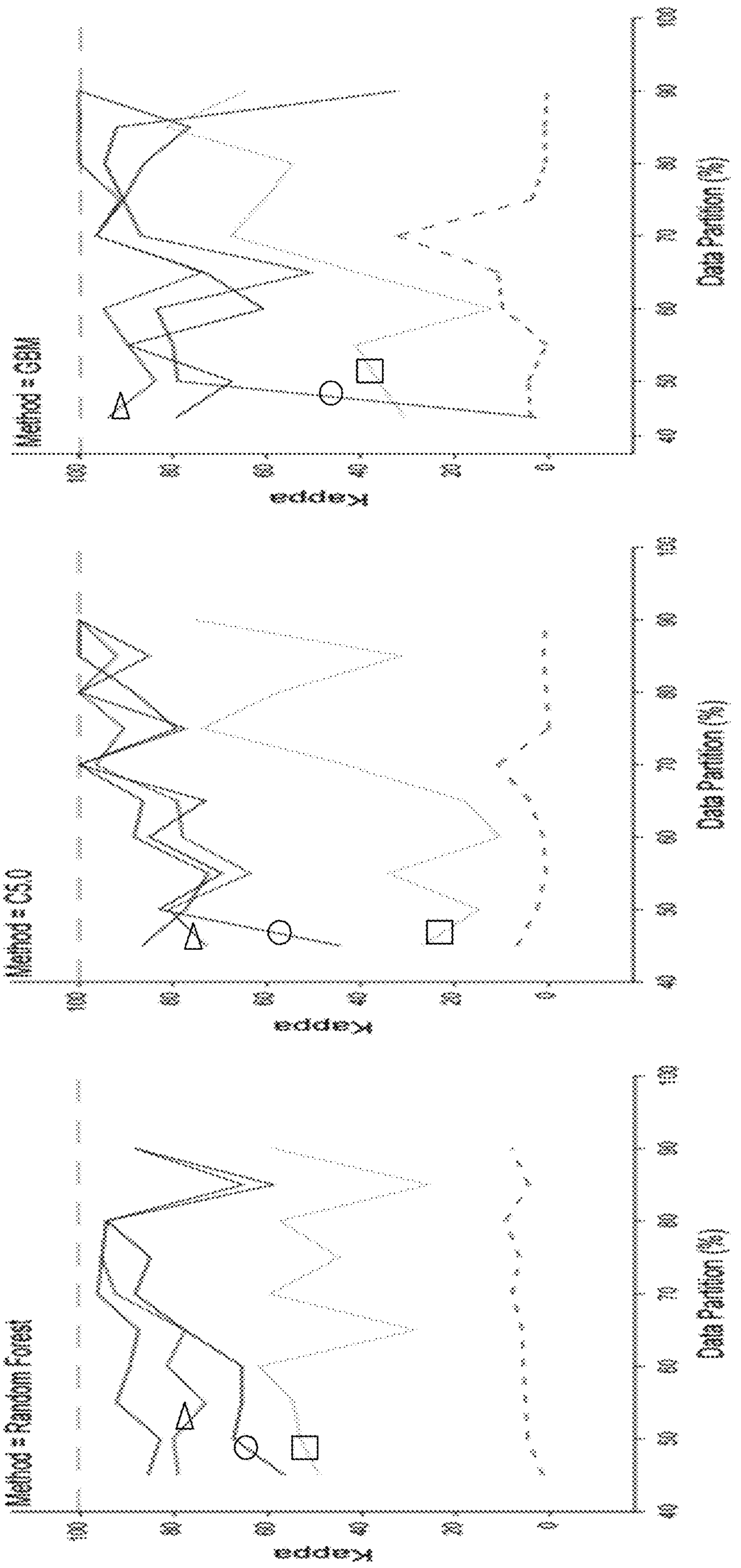

FIG. 11 shows data for the three best performing ML algorithms. The data shows the impact on partitioning whether the protocol uses oversample, down sample, Rose or Smote. Oversampling in each instance provided the highest model Kappa and Accuracy with the optimal performance somewhere between 70-80%.

Figure 12A:
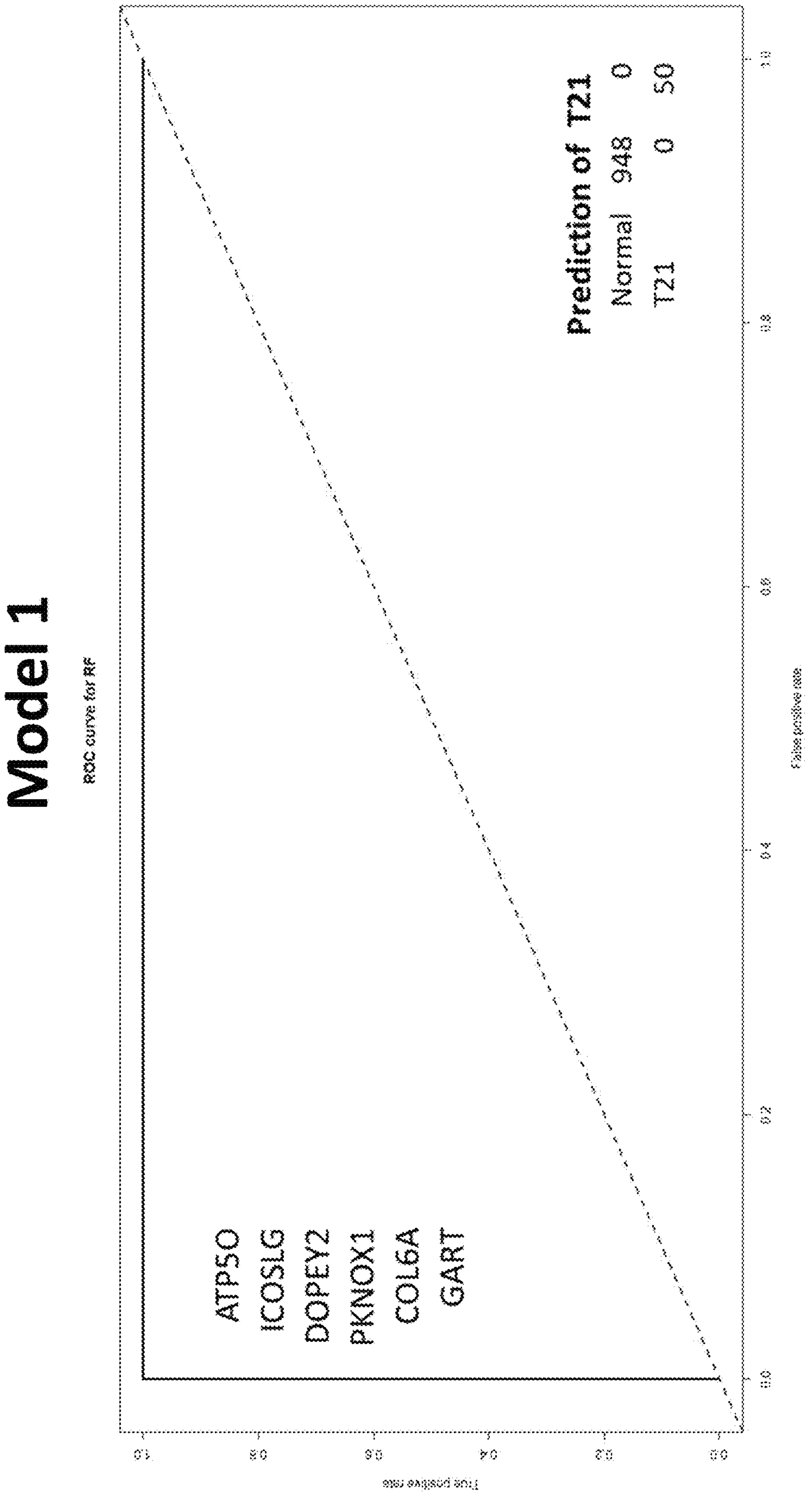
FIG. 12A shows a specific 6 plasma cell free RNA group that happens to consist of mRNA that are products of genes located on the number 21 chromosome.
Figure 12B:
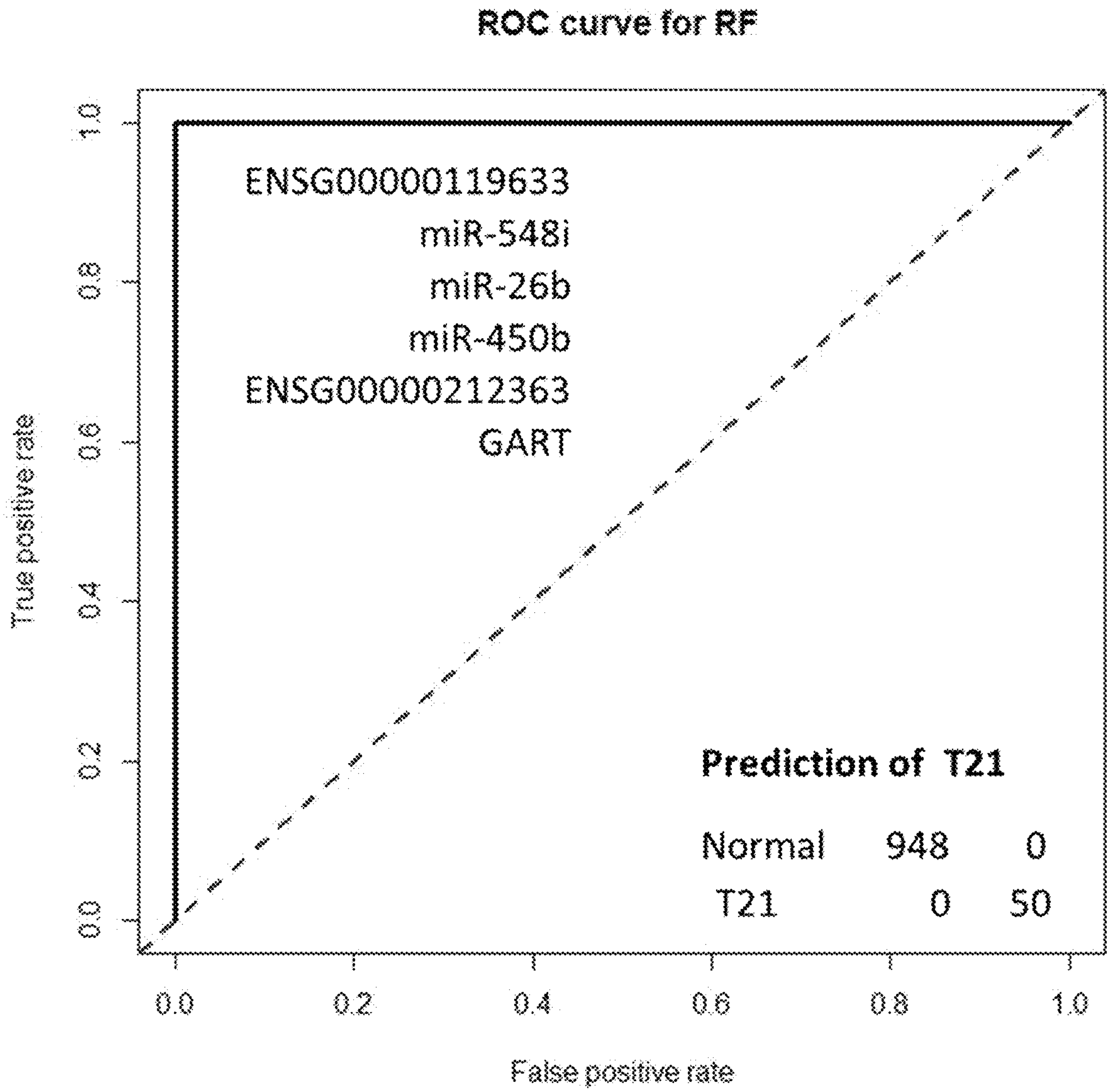
FIG. 12B shows a specific 6 plasma cell free RNA group that consist of 5 small noncoding RNAs produced by genes located on a chromosome other than the number 21, and 1 mRNA that is a product of a gene located on the number 21 chromosome.
Figure 12C:
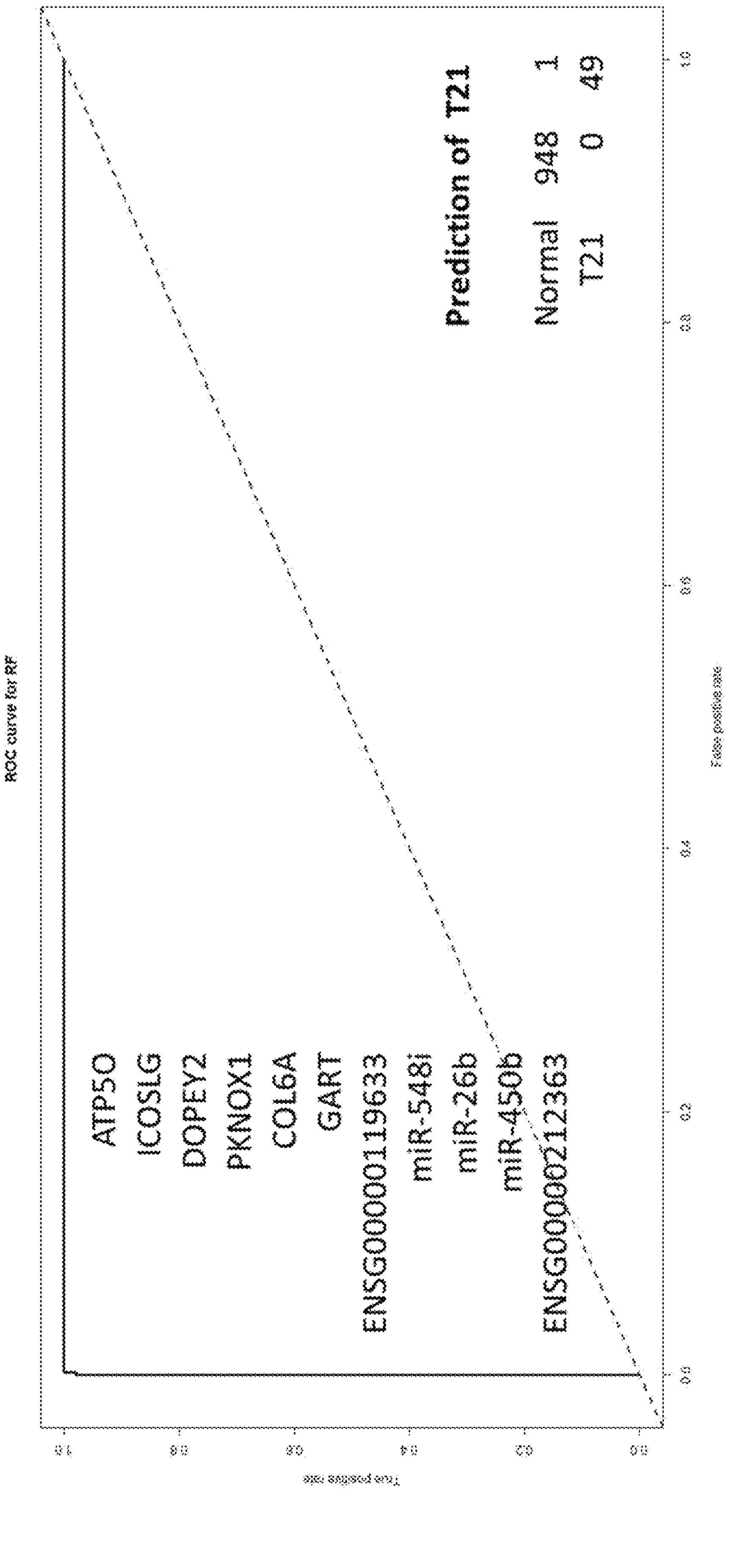
FIG. 12C show a specific 11 plasma cell free RNA group that consists of the 11 unique RNAs identified with C5.0.

FIGS. 12A-12C shows that the group of 54 plasma cell free RNA markers were tested for the prediction of Trisomy 21 using C5.0 with bagging. The RNAs utilized in the best performing C5.0 models were then entered into Random Forest, and the diagnostic models of FIGS. 12A-12C resulted.

FIG. 12A shows a specific 6 plasma cell free RNA group that happens to consist of mRNA that are products of genes located on the number 21 chromosome. The model's accuracy is diagnostic of Trisomy 21. Thus, a specific group of the 6 plasma cell free RNA is provided for diagnostics: ATP50; ICOSLG; DOPEY2; PKNOX1; COL6A; and GART.

FIG. 12B shows a specific 6 plasma cell free RNA group that consist of 5 small noncoding RNAs produced by genes located on a chromosome other than the number 21, and 1 mRNA that is a product of a gene located on the number 21 chromosome. The model's accuracy is diagnostic of Trisomy 21. Thus, a specific group of the 6 plasma cell free RNA group is provided for diagnostics: ENSG00000119633; miR-548i; miR-26b; miR-450b; ENSG00000212363; and GART.

FIG. 12C show a specific 11 plasma cell free RNA group that consists of the 11 unique RNAs identified with C5.0. The model's accuracy is diagnostic of Trisomy 21. Thus, a specific group of the 11 plasma cell free RNA group is provided for diagnostics: ATP50; ICOSLG; DOPEY2; PKNOX1; COL6A; GART; ENSG00000119633; miR-548i; miR-26b; miR-450b; and ENSG00000212363.

The nucleic acid biomarkers can be useful because they can be detected as a combination of nucleic biomarkers in a human subject. This detected combination of biomarkers when detected to have transcription levels that are outside of normal transcriptional levels provides information about the probability of defined heath scenarios. For example, the specific combinations of the nucleic acid biomarkers having the variation from the transcriptional standard can be used for assessing the likelihood of trisomy 21. Accordingly, methods are described herein for detecting the combination of nucleic biomarkers. The combination of biomarkers being upregulated or downregulated provide an indication that the subject pregnant female carries a fetus having trisomy 21. The results of the combination of biomarkers can be obtained, and the variation for each detected to be: no variation; an upregulation; or a downregulation. A report can be generated to identify the variation of each biomarker in the combination, and the results thereof relative to the patient being sampled for the biomarker combination. The report can further provide a recommendation for further medical evaluations to confirm whether or not the presence of the combination of nucleic acid biomarkers was a true positive result or a false positive result. For example, the presence of the combination of biomarkers can provide an indication of the corresponding fetus having T21, and the report can provide recommendations of specific medical protocols for confirming whether or not the indication is true or false. The methods may also include the performance of the subsequent medical procedure to confirm the indication to be true or false, whereby a report can be generated regarding the indication by the presence of the combination of biomarkers compared to the outcome or results of the subsequent medical procedure.

In some embodiments, a method of detecting a combination of nucleic acid biomarkers in a human subject can include: obtaining a nucleic acid sample from the human subject; analyzing a transcriptome of the human subject for the combination of nucleic acid biomarkers in the nucleic acid sample from the human subject; selecting the combination of nucleic acid biomarkers; detecting in the nucleic acid sample the presence of the combination of nucleic acid biomarkers, wherein each nucleic acid biomarker in the combination of nucleic acid biomarkers has a variation from a transcription standard, wherein the combination of nucleic acid biomarkers includes: ATP50 having a nucleotide sequence of or complementary to SEQ ID NO: 3249; ICOSLG having a nucleotide sequence of or complementary to SEQ ID NO: 3265; DOP1B (also known as DOPEY2) having a nucleotide sequence of or complementary to SEQ ID NO: 3250; PKNOX1 having a nucleotide sequence of or complementary to SEQ ID NO: 3254; COL6A1 having a nucleotide sequence of or complementary to SEQ ID NO: 3272; GART having a nucleotide sequence of or complementary to SEQ ID NO: 3256; ENSG00000199633 F2 having a nucleotide sequence of or complementary to SEQ ID NO: 3217; hsa-mir-548I having a nucleotide sequence of or complementary to SEQ ID NO: 3165; hsa-mir-26b having a nucleotide sequence of or complementary to SEQ ID NO: 3161; hsa-mir-450b having a nucleotide sequence of or complementary to SEQ ID NO: 3246; and ENSG00000212363 having a nucleotide sequence of or complementary to SEQ ID NO: 3170. Table 1 shows this combination of nucleic acid biomarkers—Group 1—as a defined panel where each must be present and detected for a variation of no variation; an upregulation; or a downregulation.

TABLE 1

| Group 1-Combination of Biomarkers | | | | | | |
|---|---|---|---|---|---|---|
| SEQ ID NO: | Group ID NO: | Gene Name | p-value | Type/Ref | Chromosome | Up or Down Regulation |
| 3249 | 28 | ATP5O | <0.01 | NM_001697.3 | 21 | Down |
| 3265 | 31 | ICOSLG | <0.01 | NM_015259 | 21 | Down |
| 3250 | 33 | DOP1B | <0.01 | NM_005128 | 21 | Down |
| 3254 | 46 | PKNOX1 | <0.01 | NM_004571 | 21 | Up |
| 3272 | 52 | COL6A1 | <0.01 | NM_001848 | 21 | Down |
| 3256 | 54 | GART | <0.01 | NM_000819 | 21 | Down |
| 3217 | 1 | ENSG00000199633 F2 | <0.01 | snoRNA | 15 | Up |
| 3165 | 5 | hsa-mir-548I | <0.01 | miRNA | 3 | Down |
| 3161 | 10 | hsa-mir-26b | <0.01 | miRNA | 2 | Down |
| 3246 | 12 | hsa-mir-450b | <0.01 | miRNA | X | Down |
| 3170 | 13 | ENSG00000212363 | <0.01 | snoRNA | 5 | Down |

The information in the tables provides the original Biomarker SEQ ID NO:, Group ID, Gene name, p value, Reference sequence number, Chromosome of Origin and the direction of gene regulation when the fetus has Trisomy 21.

In some embodiments, the combination of nucleic acid biomarkers includes: ATP50 having a nucleotide sequence of or complementary to SEQ ID NO: 3249 with a transcriptional variation that is downregulated compared to the transcription standard; ICOSLG having a nucleotide sequence of or complementary to SEQ ID NO: 3265 with a transcriptional variation that is downregulated compared to the transcription standard; DOP1B having a nucleotide sequence of or complementary to SEQ ID NO: 3250 with a transcriptional variation that is downregulated compared to the transcription standard; PKNOX1 having a nucleotide sequence of or complementary to SEQ ID NO: 3254 with a transcriptional variation that is upregulated compared to the transcription standard; COL6A1 having a nucleotide sequence of or complementary to SEQ ID NO: 3272 with a transcriptional variation that is downregulated compared to the transcription standard; GART having a nucleotide sequence of or complementary to SEQ ID NO: 3256 with a transcriptional variation that is downregulated compared to the transcription standard; ENSG00000199633 F2 having a nucleotide sequence of or complementary to SEQ ID NO: 3217 with a transcriptional variation that is upregulated compared to the transcription standard; hsa-mir-548I having a nucleotide sequence of or complementary to SEQ ID NO: 3165 with a transcriptional variation that is downregulated compared to the transcription standard; hsa-mir-26b having a nucleotide sequence of or complementary to SEQ ID NO: 3161 with a transcriptional variation that is downregulated compared to the transcription standard; hsa-mir-450b having a nucleotide sequence of or complementary to SEQ ID NO: 3246 with a transcriptional variation that is downregulated compared to the transcription standard; and ENSG00000212363 having a nucleotide sequence of or complementary to SEQ ID NO: 3170 with a variation less than the transcription standard.

In some embodiments, the combination of nucleic acid biomarkers is: ENSG00000199633 F2 having a nucleotide sequence of or complementary to SEQ ID NO: 3217; hsa-mir-548I having a nucleotide sequence of or complementary to SEQ ID NO: 3165; hsa-mir-26b having a nucleotide sequence of or complementary to SEQ ID NO: 3161; hsa-mir-450b having a nucleotide sequence of or complementary to SEQ ID NO: 3246; ENSG00000212363 having a nucleotide sequence of or complementary to SEQ ID NO: 3170; and GART having a nucleotide sequence of or complementary to SEQ ID NO: 3256. Table 2 shows this combination of nucleic acid biomarkers—Group 2—as a defined panel where each must be present and detected for a variation of no variation; an upregulation; or a downregulation.

TABLE 2

| Group 2-Combination of Biomarkers | | | | | | |
|---|---|---|---|---|---|---|
| SEQ ID NO: | Group ID NO: | Gene Name | p-value | Type/Ref | Chromosome | Up or Down Regulation |
| 3217 | 1 | ENSG00000199633 F2 | <0.01 | snoRNA | 15 | Up |
| 3165 | 5 | hsa-mir-548I | <0.01 | miRNA | 3 | Down |
| 3161 | 10 | hsa-mir-26b | <0.01 | miRNA | 2 | Down |
| 3246 | 12 | hsa-mir-450b | <0.01 | miRNA | X | Down |
| 3170 | 13 | ENSG00000212363 | <0.01 | snoRNA | 5 | Down |
| 3256 | 54 | GART-Hs00531926_m1 | <0.01 | mRNA/NM_000819 | 21 | Down |

In some embodiments, the combination of nucleic acid biomarkers is: ENSG00000199633 F2 having a nucleotide sequence of or complementary to SEQ ID NO: 3217 with a transcriptional variation that is upregulated compared to the transcription standard; hsa-mir-548I having a nucleotide sequence of or complementary to SEQ ID NO: 3165 with a transcriptional variation that is downregulated compared to the transcription standard; hsa-mir-26b having a nucleotide sequence of or complementary to SEQ ID NO: 3161 with a transcriptional variation that is downregulated compared to the transcription standard; hsa-mir-450b having a nucleotide sequence of or complementary to SEQ ID NO: 3246 with a transcriptional variation that is downregulated compared to the transcription standard; and ENSG00000212363 having a nucleotide sequence of or complementary to SEQ ID NO: 3170 with a variation less than the transcription standard; and GART having a nucleotide sequence of or complementary to SEQ ID NO: 3256 with a transcriptional variation that is downregulated compared to the transcription standard.

In some embodiments, the combination of nucleic acid biomarkers is: ATP50 having a nucleotide sequence of or complementary to SEQ ID NO: 3249; ICOSLG having a nucleotide sequence of or complementary to SEQ ID NO: 3265; DOP1B having a nucleotide sequence of or complementary to SEQ ID NO: 3250; PKNOX1 having a nucleotide sequence of or complementary to SEQ ID NO: 3254; COL6A1 having a nucleotide sequence of or complementary to SEQ ID NO: 3272; and GART having a nucleotide sequence of or complementary to SEQ ID NO: 3256. Table 3 shows this combination of nucleic acid biomarkers—Group 3—as a defined panel where each must be present and detected for a variation of no variation; an upregulation; or a downregulation.

TABLE 3

| Group 3-Combination of Biomarkers | | | | | | |
|---|---|---|---|---|---|---|
| SEQ ID NO: | Group ID NO: | Gene Name | p-value | Type/Ref | Chromosome | Up or Down Regulation |
| 3249 | 28 | ATP5O | <0.01 | NM_001697.3 | 21 | Down |
| 3265 | 31 | ICOSLG | <0.01 | NM_015259 | 21 | Down |
| 3250 | 33 | DOP1B | <0.01 | NM_005128 | 21 | Down |
| 3254 | 46 | PKNOX1 | <0.01 | NM_004571 | 21 | Up |
| 3272 | 52 | COL6A1 | <0.01 | NM_001848 | 21 | Down |
| 3256 | 54 | GART | <0.01 | NM_000819 | 21 | Down |

In some embodiments, the combination of nucleic acid biomarkers is: ATP50 having a nucleotide sequence of or complementary to SEQ ID NO: 3249 with a transcriptional variation that is downregulated compared to the transcription standard; ICOSLG having a nucleotide sequence of or complementary to SEQ ID NO: 3265 with a transcriptional variation that is downregulated compared to the transcription standard; DOP1B having a nucleotide sequence of or complementary to SEQ ID NO: 3250 with a transcriptional variation that is downregulated compared to the transcription standard; PKNOX1 having a nucleotide sequence of or complementary to SEQ ID NO: 3254 with a transcriptional variation that is upregulated compared to the transcription standard; COL6A1 having a nucleotide sequence of or complementary to SEQ ID NO: 3272 with a transcriptional variation that is downregulated compared to the transcription standard; and GART having a nucleotide sequence of or complementary to SEQ ID NO: 3256 with a transcriptional variation that is downregulated compared to the transcription standard.

In some embodiments, the combination of nucleic acid biomarkers in Group 1 (Table 1) further comprises a sub-group of biomarkers (A) to form Group 1A, which Group 1A includes the biomarkers of Group 1 and the following additional sub-group (A) of mRNA biomarkers: RASGRP4 having a nucleotide sequence of or complementary to SEQ ID NO: 3257; FAM20A having a nucleotide sequence of or complementary to SEQ ID NO: 3258; NEK9 having a nucleotide sequence of or complementary to SEQ ID NO: 3259; ABCC1 having a nucleotide sequence of or complementary to SEQ ID NO: 3260; SORBS2 having a nucleotide sequence of or complementary to SEQ ID NO: 3261; TMPRSS2 having a nucleotide sequence of or complementary to SEQ ID NO: 3262; DSCAM having a nucleotide sequence of or complementary to SEQ ID NO: 3263; ERG having a nucleotide sequence of or complementary to SEQ ID NO: 3264; ICOSLG having a nucleotide sequence of or complementary to SEQ ID NO: 3265; C21orf33 having a nucleotide sequence of or complementary to SEQ ID NO:

3266; ADAMTS5 having a nucleotide sequence of or complementary to SEQ ID NO: 3267; CXADR having a nucleotide sequence of or complementary to SEQ ID NO: 3268; PFKL having a nucleotide sequence of or complementary to SEQ ID NO: 3269; SLC19A1 having a nucleotide sequence of or complementary to SEQ ID NO: 3270; PRDM15 having a nucleotide sequence of or complementary to SEQ ID NO: 3271; COL6A1 having a nucleotide sequence of or complementary to SEQ ID NO: 3272; and ABCG1 having a nucleotide sequence of or complementary to SEQ ID NO: 3273.

In some aspects, the combination of nucleic acid biomarkers in Group 1 (Table 1) further comprises a sub-group of biomarkers to form Group 1A, which Group 1A includes the biomarkers of Group 1 and the following additional biomarkers: RASGRP4 having a nucleotide sequence of or complementary to SEQ ID NO: 3257 with a transcriptional variation that is downregulated compared to the transcription standard; FAM20A having a nucleotide sequence of or complementary to SEQ ID NO: 3258 with a transcriptional variation that is downregulated compared to the transcription standard; NEK9 having a nucleotide sequence of or complementary to SEQ ID NO: 3259 with a transcriptional variation that is downregulated or upregulated compared to the transcription standard; ABCC1 having a nucleotide sequence of or complementary to SEQ ID NO: 3260 with a transcriptional variation that is upregulated compared to the transcription standard; SORBS2 having a nucleotide sequence of or complementary to SEQ ID NO: 3261 with a transcriptional variation that is downregulated or upregulated compared to the transcription standard; TMPRSS2 having a nucleotide sequence of or complementary to SEQ ID NO: 3262 with a transcriptional variation that is downregulated compared to the transcription standard; DSCAM having a nucleotide sequence of or complementary to SEQ ID NO: 3263 with a transcriptional variation that is downregulated compared to the transcription standard; ERG having a nucleotide sequence of or complementary to SEQ ID NO: 3264 with a transcriptional variation that is upregulated compared to the transcription standard; ICOSLG having a nucleotide sequence of or complementary to SEQ ID NO: 3265 with a transcriptional variation that is downregulated compared to the transcription standard; C21orf33 having a nucleotide sequence of or complementary to SEQ ID NO: 3266 with a transcriptional variation that is downregulated compared to the transcription standard; ADAMTS5 having a nucleotide sequence of or complementary to SEQ ID NO: 3267 with a transcriptional variation that is downregulated compared to the transcription standard; CXADR having a nucleotide sequence of or complementary to SEQ ID NO: 3268 with a transcriptional variation that is downregulated compared to the transcription standard; PFKL having a nucleotide sequence of or complementary to SEQ ID NO: 3269 with a transcriptional variation that is upregulated compared to the transcription standard; SLC19A1 having a nucleotide sequence of or complementary to SEQ ID NO: 3270 with a transcriptional variation that is upregulated compared to the transcription standard; PRDM15 having a nucleotide sequence of or complementary to SEQ ID NO: 3271 with a transcriptional variation that is downregulated compared to the transcription standard; COL6A1 having a nucleotide sequence of or complementary to SEQ ID NO: 3272 with a transcriptional variation that is downregulated compared to the transcription standard; and ABCG1 having a nucleotide sequence of or complementary to SEQ ID NO: 3273 with a transcriptional variation that is downregulated compared to the transcription standard.

In some embodiments, the combination of nucleic acid biomarkers in Group 1 (Table 1) further comprises a second sub-group (B) of biomarkers to form Group 1B, which Group 1B includes the biomarkers of Group 1 and the following additional biomarkers (B) sub-group (B) are small non-coding RNA that can include: ENSG00000199633 F2 having a nucleotide sequence of or complementary to SEQ ID NO: 3217; ENSG00000207147 F2 having a nucleotide sequence of or complementary to SEQ ID NO: 3238; hsa-let-7d F1 having a nucleotide sequence of or complementary to SEQ ID NO: 3189; hsa-mir-569 F1 having a nucleotide sequence of or complementary to SEQ ID NO: 3163; hsa-mir-548I having a nucleotide sequence of or complementary to SEQ ID NO: 3165; ENSG00000201980 having a nucleotide sequence of or complementary to SEQ ID NO: 3195; ENSG00000202231 having a nucleotide sequence of or complementary to SEQ ID NO: 3243; hsa-mir-216b having a nucleotide sequence of or complementary to SEQ ID NO: 3160; hsa-mir-98 having a nucleotide sequence of or complementary to SEQ ID NO: 3245; hsa-mir-26b having a nucleotide sequence of or complementary to SEQ ID NO: 3161; hsa-mir-581 F1 having a nucleotide sequence of or complementary to SEQ ID NO: 3173; hsa-mir-450b having a nucleotide sequence of or complementary to SEQ ID NO: 3246; ENSG00000212363 having a nucleotide sequence of or complementary to SEQ ID NO: 3170; ENSG00000199282 having a nucleotide sequence of or complementary to SEQ ID NO: 3207; hsa-mir-523 having a nucleotide sequence of or complementary to SEQ ID NO: 3233; hsa-mir-376a-2/1 F2 having a nucleotide sequence of or complementary to SEQ ID NO: 3214; ENSG00000199856 F1 having a nucleotide sequence of or complementary to SEQ ID NO: 3230; and HBII-276 F2 having a nucleotide sequence of or complementary to SEQ ID NO: 3184.

In some aspects, sub-group (B) are small non-coding RNA that can include: ENSG00000199633 F2 having a nucleotide sequence of or complementary to SEQ ID NO: 3217 with a transcriptional variation that is upregulated compared to the transcription standard; ENSG00000207147 F2 having a nucleotide sequence of or complementary to SEQ ID NO: 3238 with a transcriptional variation that is upregulated compared to the transcription standard; hsa-let-7d F1 having a nucleotide sequence of or complementary to SEQ ID NO: 3189 with a transcriptional variation that is upregulated compared to the transcription standard; hsa-mir-569 F1 having a nucleotide sequence of or complementary to SEQ ID NO: 3163 with a transcriptional variation that is downregulated compared to the transcription standard; hsa-mir-548I having a nucleotide sequence of or complementary to SEQ ID NO: 3165 with a transcriptional variation that is downregulated compared to the transcription standard; ENSG00000201980 having a nucleotide sequence of or complementary to SEQ ID NO: 3195 with a transcriptional variation that is upregulated compared to the transcription standard; ENSG00000202231 having a nucleotide sequence of or complementary to SEQ ID NO: 3243 with a transcriptional variation that is downregulated compared to the transcription standard; hsa-mir-216b having a nucleotide sequence of or complementary to SEQ ID NO: 3160 with a transcriptional variation that is upregulated compared to the transcription standard; hsa-mir-98 having a nucleotide sequence of or complementary to SEQ ID NO: 3245 with a transcriptional variation that is downregulated compared to the transcription standard; hsa-mir-26b having a nucleotide sequence of or complementary to SEQ ID NO: 3161 with a transcriptional variation that is downregulated compared to the transcription standard; hsa-mir-581 F1 having a nucleotide sequence of or complementary to SEQ ID NO: 3173 with a transcriptional variation that is upregulated compared to the transcription standard; hsa-mir-450b having a nucleotide sequence of or complementary to SEQ ID NO: 3246 with a transcriptional variation that is downregulated compared to the transcription standard; ENSG00000212363 having a nucleotide sequence of or complementary to SEQ ID NO: 3170 with a transcriptional variation that is downregulated compared to the transcription standard; ENSG00000199282 having a nucleotide sequence of or complementary to SEQ ID NO: 3207 with a transcriptional variation that is downregulated compared to the transcription standard; hsa-mir-523 having a nucleotide sequence of or complementary to SEQ ID NO: 3233 with a transcriptional variation that is downregulated compared to the transcription standard; hsa-mir-376a-2/1 F2 having a nucleotide sequence of or complementary to SEQ ID NO: 3214 with a transcriptional variation that is downregulated compared to the transcription standard; ENSG00000199856 F1 having a nucleotide sequence of or complementary to SEQ ID NO: 3230 with a transcriptional variation that is downregulated compared to the transcription standard; and HBII-276 F2 having a nucleotide sequence of or complementary to SEQ ID NO: 3184 with a transcriptional variation that is upregulated compared to the transcription standard.

In some embodiments, the combination of nucleic acid biomarkers in Group 1 (Table 1) further comprises the first sub-group of biomarkers (A) and the second sub-group of biomarkers (B) to form Group 1C of biomarkers, which Group 1C includes the RNA biomarkers of Group 1 and the first sub-group (A) mRNA biomarkers and the sub-group (B) of small non-coding RNA biomarkers.

In some embodiments, Group 1A characterized with sub-group D results in Group 1AD. In some embodiments, Group 1C characterized with the sub-group D results in Group 1 and Group 1CD.

In some embodiments, the Group 1 of Table I can have one or more of the biomarkers being a specific examples of the combination of nucleic acid biomarkers—Group 1—as a defined panel where each must be present and detected for a variation of no variation; an upregulation; or a downregulation. As such, in view of Table 1, Group 1 can be specified in the following example: ATP50 including ATP50-Hs04272738_m1 with a transcriptional variation that is downregulated compared to the transcription standard; ICOSLG including ICOSLG-Hs00391287_m1 with a transcriptional variation that is downregulated compared to the transcription standard; DOP1B including DOP1B-Hs01123288_m1 with a transcriptional variation that is downregulated compared to the transcription standard; PKNOX1 including PKNOX1-Hs01007092_m1 with a transcriptional variation that is upregulated compared to the transcription standard; COL6A1 including COL6A1-Hs01095585_m1 with a transcriptional variation that is downregulated compared to the transcription standard; and GART including GART-Hs00531926_m1 with a transcriptional variation that is downregulated compared to the transcription standard. In some aspects, the recited biomarkers in any of the groups can include the sample in this paragraph of that biomarker.

In some embodiments, any of the groups of biomarkers having GART, can be specified as having the following example of GART including GART-Hs00531926_m1 with a transcriptional variation that is downregulated compared to the transcription standard.

In some embodiments, the combination of nucleic acid biomarkers further comprises: FAM20A including FAM20A-Hs01034071_m1 that is downregulated compared to the transcriptional standard, and FAM20A-Hs01034070_m that is downregulated compared to the transcriptional standard; NEK9 including NEK9-Hs00929602_m1 that is downregulated compared to the transcriptional standard, and NEK9-Hs00929594_m that is upregulated compared to the transcriptional standard; SORBS2 including SORBS2-Hs01125202_m1 that is upregulated compared to the transcriptional standard and SORBS2-Hs00243432_m1 that is downregulated compared to the transcriptional standard; DOP1B including DOP1B-Hs01123288_m1 that is downregulated compared to the transcriptional standard and DOP1B-Hs01123267_g1 that is downregulated compared to the transcriptional standard; UBASH3A including UBASH3A-Hs00955169_m1 that is upregulated compared to the transcriptional standard and UBASH3A-Hs00955168_m1 that is downregulated compared to the transcriptional standard; PKNOX1 including PKNOX1-Hs01007098_m1 that is downregulated compared to the transcriptional standard and PKNOX1-Hs01007097_m1 that is downregulated compared to the transcriptional standard and PKNOX1-Hs01007094_m1 that is upregulated compared to the transcriptional standard and PKNOX1-Hs01007093_m1 that is upregulated compared to the transcriptional standard and PKNOX1-Hs01007092_m1 that is upregulated compared to the transcriptional standard and PKNOX1-Hs00231814_m1 that is downregulated compared to the transcriptional standard; and SLC19A1 including SLC19A1-Hs00953342_m1 that is upregulated compared to the transcriptional standard and SLC19A1-Hs00953341_m1 that is downregulated compared to the transcriptional standard.

In some embodiments, the combination of nucleic acid biomarkers includes or consists of: RASGRP4-Hs01073179_m1; FAM20A-Hs01034071_m1; FAM20A-Hs01034070_m1; NEK9-Hs00929602_m1; NEK9-Hs00929594_m1; ABCC1-Hs01561504_m1; SORBS2-Hs01125202_m1; SORBS2-Hs00243432_m1; TMPRSS2-ERG fusion gene; ATP50-Hs04272738_m1; DSCAM-Hs00242097_m1; ERG-Hs01573964_m1; ICOSLG-Hs00391287_m1; DOP1B-Hs01123288_m1; DOP1B-Hs01123267_g1; C21orf33-Hs01105802_g1; ADAMTS5-Hs04272736_s1; CXADR-Hs04194411_s1; NCAM2-Hs01562292_m1; UBASH3A-Hs00955169_m1; UBASH3A-Hs00955168_m1; PFKL-Hs01040525_m1; CHODL-Hs01070471_m1; PKNOX1-Hs01007098_m1; PKNOX1-Hs01007097_m1; PKNOX1-Hs01007094_m1; PKNOX1-Hs01007093_m1; PKNOX1-Hs01007092_m1; PKNOX1-Hs00231814_m1; CYYR1-Hs00951849_m1; SLC19A1-Hs00953342_m1; SLC19A1-Hs00953341_m1; PRDM15-Hs00411318_m1; COL6A1-Hs01095585_m1; ABCG1-Hs01555191_m1; GART-Hs00531926_m1; ENSG00000199633 F2; ENSG00000207147 F2; hsa-let-7d F1; hsa-mir-569 F1; hsa-mir-548I; ENSG00000201980; ENSG00000202231; hsa-mir-216b; hsa-mir-98; hsa-mir-26b; hsa-mir-581 F1; hsa-mir-450b; ENSG00000212363; ENSG00000199282; hsa-mir-523; hsa-mir-376a-2/1 F2; ENSG00000199856 F1; and HBII-276 F2.

In some embodiments, the method of using the combination of nucleic acid biomarkers includes hybridizing each nucleic acid biomarker in the nucleic acid sample with a complementary nucleic acid configured as a primer or a probe, the method comprising detecting the hybridizing. Accordingly, a combination of primers (forward and/or reverse) can be provided for each of the combinations of the specific Groups or sub-groups of the biomarkers. Accordingly, a combination of probes (e.g., labeled, bound to substrate, etc.) can be provided for each of the combinations of the specific Groups or sub-groups of the biomarkers.

In some aspects, the method can include providing the transcription standard for each nucleic acid biomarker for the combination of nucleic acid biomarkers. That is, each biomarker in each combination has a transcription standard across populations without T21. The biological sample of the pregnant mother can be assayed for the combination of nucleic acid biomarkers of one of the Groups to see whether the pregnant woman has the combination of biomarkers in that Group varying from the transcriptional standard. The presence of the combination of biomarkers having the variation from the transcription standard provide for the indication that the fetus of the pregnant mother has T21. Thus, all of the biomarkers in the specific combination of that Group is assayed in the pregnant woman. In some aspects, the method can include obtaining cell free plasma RNA as the nucleic acid sample, wherein the nucleic acid biomarkers are RNA (e.g., having RNA nucleic acids).

In some embodiments, the method can include generating a report, the report reciting the presence of the combination of nucleic acid biomarkers being present in the nucleic acid sample of the human subject being present in a biomarker amount that is varied from the transcription standard. The report can include any of the information provided herein, such as the presence of the combination of nucleic acid biomarkers having the deviation from the transcriptional standard, what such a presence of the Group of biomarkers means for the fetus, and a listing of further medical procedures and actions recommended or options to be taken.

In some embodiments, the combination of nucleic acid biomarkers is the combination defined as Group 4, shown in Table 4. Table 4 shows this combination of nucleic acid biomarkers—Group 4—as a defined panel where each must be present and detected for a variation of no variation; an upregulation; or a downregulation.

TABLE 4

Group 4-Combination of Biomarkers

| SEQ ID NO: | Group ID NO: | Gene Name | Type/Ref | Up or Down Regulation |
|---|---|---|---|---|
| 3217 | 1 | ENSG00000199633 F2 | snoRNA | Up |
| 3238 | 2 | ENSG00000207147 F2 | snoRNA | Up |
| 3189 | 3 | hsa-let-7d F1 | miRNA | Up |
| 3163 | 4 | hsa-mir-569 F1 | miRNA | Down |
| 3165 | 5 | hsa-mir-548I | miRNA | Down |
| 3195 | 6 | ENSG00000201980 | snoRNA | Up |
| 3243 | 7 | ENSG00000202231 | snoRNA | Down |
| 3160 | 8 | hsa-mir-216b | miRNA | Up |
| 3245 | 9 | hsa-mir-98 | miRNA | Down |
| 3161 | 10 | hsa-mir-26b | miRNA | Down |
| 3173 | 11 | hsa-mir-581 F1 | miRNA | Up |
| 3246 | 12 | hsa-mir-450b | miRNA | Down |
| 3170 | 13 | ENSG00000212363 | snoRNA | Down |
| 3207 | 14 | ENSG00000199282 | snoRNA | Down |
| 3233 | 15 | hsa-mir-523 | miRNA | Down |
| 3214 | 16 | hsa-mir-376a-2/1 F2 | miRNA | Down |
| 3230 | 17 | ENSG00000199856 F1 | snoRNA | Down |
| 3184 | 18 | HBII-276 F2 | CDBox | Up |
| 3257 | 19 | RASGRP4-Hs01073179_m1 | NM_170604 | Down |
| 3258 | 20 | FAM20A-Hs01034071_m1 | NR_027751 | Down |
| 3259 | 22 | NEK9-Hs00929602_m1 | NM_033116 | Down |
| 3260 | 24 | ABCC1-Hs01561504_m1 | NM_004996 | Up |
| 3261 | 25 | SORBS2-Hs01125202_m1 | NM_001145671 | Up |
| 3262 | 27 | TMPRSS2-ERG fusion gene | NM_002772 | Down |

TABLE 4-continued

Group 4-Combination of Biomarkers

| SEQ ID NO: | Group ID NO: | Gene Name | Type/Ref | Up or Down Regulation |
|---|---|---|---|---|
| 3249 | 28 | ATP5O-Hs04272738_m1 | NM_001697.3 | Down |
| 3263 | 29 | DSCAM-Hs00242097_m1 | NM_020693 | Down |
| 3264 | 30 | ERG-Hs01573964_m1 | NM_004449 | Up |
| 3265 | 31 | ICOSLG-Hs00391287_m1 | NM_015259 | Down |
| 3250 | 32 | DOP1B-Hs01123288_m1 | NM_005128 | Down |
| 3266 | 34 | C21orf33-Hs01105802_g1 | NM_004649 | Down |
| 3267 | 35 | ADAMTS5-Hs04272736_s1 | NM_007038 | Down |
| 3268 | 36 | CXADR-Hs04194411_s1 | NM_001338 | Down |
| 3251 | 37 | NCAM2-Hs01562292_ml | NM_004540.5 | Up |
| 3252 | 38 | UBASH3A-Hs00955169_m1 | NM_018961.4 | Up |
| 3269 | 40 | PFKL-Hs01040525_m1 | NR_024108 | Up |
| 3253 | 41 | CHODL-Hs01070471_m1 | NM_024944.3 | Down |
| 3254 | 46 | PKNOX1-Hs01007092_m1 | | Up |
| 3255 | 48 | CYYR1-Hs00951849_m1 | NR_135472 | Up |
| 3270 | 49 | SLC19A1-Hs00953342_m1 | NM_194255 | Up |
| 3271 | 51 | PRDM15-Hs00411318_m1 | NM_022115 | Down |
| 3272 | 52 | COL6A1-Hs01095585_m1 | NM_001848 | Down |
| 3273 | 53 | ABCG1-Hs01555191_m1 | NM_016818 | Down |
| 3256 | 54 | GART-Hs00531926_m1 | NM_000819 | Down |

In some embodiments, the combination of nucleic acid biomarkers is the combination defined as Group 5, shown in Table 5. Table 5 shows this combination of nucleic acid biomarkers—Group 5—as a defined panel where each must be present and detected for a variation of no variation; an upregulation; or a downregulation.

TABLE 5

Group 5-Combination of Biomarkers

| SEQ ID NO: | Group ID NO: | Gene Name | Type/Ref | Up or Down Regulation |
|---|---|---|---|---|
| 3257 | 19 | RASGRP4-Hs01073179_m1 | NM_170604 | Down |
| 3258 | 20 | FAM20A-Hs01034071_m1 | NR_027751 | Down |
| 3259 | 22 | NEK9-Hs00929602_m1 | NM_033116 | Down |
| 3260 | 24 | ABCC1-Hs01561504_m1 | NM_004996 | Up |
| 3261 | 25 | SORBS2-Hs01125202_m1 | NM_001145671 | Up |
| 3262 | 27 | TMPRSS2-ERG fusion gene | NM_002772 | Down |
| 3249 | 28 | ATP5O-Hs04272738_m1 | NM_001697.3 | Down |
| 3263 | 29 | DSCAM-Hs00242097_m1 | NM_020693 | Down |
| 3264 | 30 | ERG-Hs01573964_m1 | NM_004449 | Up |
| 3265 | 31 | ICOSLG-Hs00391287_m1 | NM_015259 | Down |
| 3250 | 32 | DOP1B-Hs01123288_m1 | NM_005128 | Down |
| 3266 | 34 | C21orf33-Hs01105802_g1 | NM_004649 | Down |
| 3267 | 35 | ADAMTS5-Hs04272736_s1 | NM_007038 | Down |
| 3268 | 36 | CXADR-Hs04194411_s1 | NM_001338 | Down |
| 3251 | 37 | NCAM2-Hs01562292_m1 | NM_004540.5 | Up |
| 3252 | 38 | UBASH3A-Hs00955169_ml | NM_018961.4 | Up |
| 3269 | 40 | PFKL-Hs01040525_m1 | NR_024108 | Up |
| 3253 | 41 | CHODL-Hs01070471_m1 | NM_024944.3 | Down |
| 3254 | 46 | PKNOX1-Hs01007092_m1 | | Up |
| 3255 | 48 | CYYR1-Hs00951849_m1 | NR 135472 | Up |
| 3270 | 49 | SLC19A1-Hs00953342_m1 | NM_194255 | Up |
| 3271 | 51 | PRDM15-Hs00411318_m1 | NM_022115 | Down |
| 3272 | 52 | COL6A1-Hs01095585_m1 | NM_001848 | Down |
| 3273 | 53 | ABCG1-Hs01555191_m1 | NM_016818 | Down |
| 3256 | 54 | GART-Hs00531926_m1 | NM_000819 | Down |

In one embodiment, the present invention includes a method of determining a primer or a probe for a CFP RNA biomarker. Such a method can include analyzing one or more of the sequences of the Sequence Listing or Figures and determining a unique or sufficiently unique specific target sequence that is useful as a primer or a probe therefore. The primers can be readily determined from the sequences of the sequence listing by convention techniques, and may encompass low stringency, medium stringency and high stringency primers, and thereby the primer sequences that are useful can be changed within the sequences provided in the Sequence Listing.

In one embodiment, the CFP RNA biomarkers can be used to indicate whether or not a fetus of a pregnant woman has T21. This determination can be performed by a blood test at least as early as 10 weeks gestation. Accordingly, the biomarkers identified herein can be combined in a mathematical algorithm that can predict likelihood of T21. The mathematics to create the algorithm is well known and not proprietary. Such an algorithm for predicting likelihood of T21 can be run on a computing system, and may be configured as software and/or or hardware. Data can be input into the computing system in order to operate and optimize the T21 prediction algorithm.

The results of a subject's diagnosis (T21) or the information of the Group of the combination of biomarkers, screening, prognosis or monitoring is typically displayed or provided to a user such as a clinician, health care worker or other caregiver, laboratory personnel or the patient. The results may be quantitative information (e.g. the level or amount of a marker compared to a control) or qualitative information (e.g. diagnosis of spontaneous preterm birth) for all biomarkers in the defined Group. The output can comprise guidelines or instructions for interpreting the results, for example, numerical or other limits that indicate the presence or absence of T21. The guidelines may also specify the diagnosis, for example whether there is a high risk of T21. The output can include tools for interpreting the results to arrive at a diagnosis, prognosis or treatment plan, for example, an output may include ranges or cut-offs for abnormal or normal status to arrive at a diagnosis, prognosis, or treatment plan or further diagnostic confirmation procedure. The output can also provide a recommended therapeutic plan, and it may include other clinical information and guidelines and instructions for interpreting the information.

Devices known in the art can be used to transmit the results of a method of the invention. Examples of output devices include without limitation, a visual output device (e.g. a computer screen or a printed paper), an auditory output device (e.g., a speaker), a printer or a patient s electronic medical record. The format of the output providing the results and related information may be a visual output (e.g., paper or a display on a screen), a diagram such as a graph, chart or voltammetric trace, an audible output (e.g. a speaker) or, a numerical value. In an aspect, the output is a numerical value, in particular the amount or relative amount of each biomarker of a specific combination of biomarkers in a subject's sample compared to a control. In an aspect, the output is a graph that indicates a value, such as an amount or relative amount, of the at least one marker in the sample from the subject on a standard curve. In an embodiment, the output (such as a graphical output) shows or provides a cut-off value or level that indicates the presence of high risk of T21. An output may be communicated to a user by physical, audible or electronic means, including mail, telephone, facsimile transmission, email or an electronic medical record.

The analytic methods described herein can be implemented by use of computer systems and methods described below and known in the art. Thus the invention provides computer readable media comprising one or more combinations of biomarkers, and optionally other markers (e.g. markers of T21). "Computer readable media" refers to any medium that can be read and accessed directly by a computer. Thus, the invention contemplates computer readable medium having recorded thereon markers identified for patients and controls. "Recorded" refers to a process for storing information on computer readable medium. The skilled artisan can readily adopt any of the presently known methods for recording information on computer readable medium to generate manufactures comprising information on one or more combinations of biomarkers.

A variety of data processor programs and formats can be used to store information on one or more combinations of biomarkers, and other markers on computer readable medium. Any number of data processor structuring formats (e.g., text file or database) may be adapted in order to obtain computer readable medium having recorded thereon the marker information.

By providing the combination of biomarker information in computer readable form, one can routinely access the information for a variety of purposes. For example, one skilled in the art can use the information in computer readable form to compare marker information obtained during or following therapy with the information stored within the data storage means.

The invention still further provides a system for identifying selected records that identify T21. A system of the invention generally comprises a computer; a database server coupled to the computer; a database coupled to the database server having data stored therein, the data comprising records of data comprising one or more combinations of biomarkers, and a code mechanism for applying queries based upon a desired selection criteria to the data file in the database to produce reports of records which match the desired selection criteria.

The invention contemplates a method for determining whether a subject has T21 comprising: (a) receiving phenotypic and/or clinical information on the subject and information on one or more combinations of biomarkers, associated with samples from the subject; (b) acquiring information from a network corresponding to the one or more combinations of biomarkers; and (c) based on the phenotypic information, information on one or more combinations of biomarkers, and optionally other markers, and acquired information, determining whether the subject has T21; and (d) optionally recommending a procedure or treatment.

Example 1

T21 Cell Free Plasma Biomarker Confirmation Protocol

Presented here is an example of an assay that was used to confirm the microarray biomarker identification for those biomarkers identified as altered in pregnant mothers carrying a fetus that has trisomy 21. More than 1 million exon clusters and 1769 non-coding small RNAs were screened by Affymetrix GeneChip Human Exon ST and Affymetrix GeneChip miRNA Arrays, respectively. PCF RNA was extracted, reverse transcribed and run on the microarrays. The mean PCF total RNA extracted per sample was 25.02 ug+/−14 ug (range 9.60-72.63 ug). Of the 232,119 exons read, 2,686 (1.2%) were located on the #21 chromosome. 3,095 of all exons (1.3%) were differentially expressed compared to Normal. Of those differentially expressed, only 38 (1.2%) originated from the #21 chromosome. Of the 1769 small noncoding human RNAs on the microarray, 16 (0.9%) originated from genes on the #21 chromosome. There were 371 small, noncoding RNAs (21%) differentially expressed in T21 compared to Normal. Only 1 differentially expressed small noncoding RNA originated from a gene located on the

#21 chromosome (0.3%). After reordering potential marker RNAs by p value and narrowness of distribution, the 36 highest scoring exons representing 36 mRNAs (19 serendipitously originating from a gene on the #21 chromosome) and the 18 highest scoring small noncoding RNAs (including 1 originating from a gene on the #21 chromosome) were confirmed by q-PCR (Table 2). These 54 RNAs were then subject to Validation testing. These data confirm that the microarray analysis functioned as designed and identified RNAs that were informative of the trisomy 21 status of the fetus.

Blood Plasma Cell Free RNA isolation. RNA is obtained using a process based on a phenol/guanidium isothiocyanate/glycerol phase separation.

RNA concentration. RNA concentration was measured by using a Qubit® 2.0 Fluorometer (Life Technologies, Grand Island, NY) as recommended by the manufacturer.

Briefly, calibration of the Qubit® 2.0 Fluorometer was done using Standard #1 and #2. Working solution was prepared by diluting the Qubit™ RNA reagent at 1:200 in Qubit™ RNA buffer. Working solution (190 ul) and 10 ul of standard or RNA sample were mixed, then incubate at room temperature for 2 minutes. The RNA concentration was determined.

Reverse Transcription.

mRNA RT: The RNA samples were diluted, and a master mix prepared including dNTP mix, Omniscript Reverse Transcriptase and Random Primer (Invitrogen, Carlsbad CA). The mRNA of each sample was converted into cDNA at 37° C. for 60 min per manufacturer instructions.

miRNA RT: The miRs were polyadenylated using reagents from the Invitrogen NCode miRNA First-Strand cDNA Synthesis Kit (ThermoFisher). The polyadenylated microRNA was reverse transcribed to generate the first strand of cDNA according to the manufactory's protocol.

Preamplification and qPCR: Multiplex qPCR reactions were performed by SYBR green using the ViiA 7 Real-Time PCR System. The primers for the gene panels were custom designed and synthesized by Integrated DNA Technologies (IDT, Coralville, IA). The probe sets in each reaction well included primers for the biomarker, normalization, and spike genes so that all three genes were run in the same reaction well to minimize assay variation. Information about the primer sequences used is available from the authors. Preamplification was performed, 1 ul RT samples were prepared for the preamplification Mix Reaction and underwent 12 cycles. Two customized probe-based microfluidic PCR Cards with 384 wells were developed for the selected mRNA and small noncoding RNA markers using a proprietary method (Rosetta Signaling Laboratory, Mission Hills, KS). The probe sets in each well included primers for biomarker, normalization, and spike genes so that all three were run in the same reaction well to minimize assay variation. One ul RT samples were prepared with the preamplification Mix Reaction and underwent 12 cycles. Two ul preamplification cDNA samples were diluted into 10 ul PCR reaction mix, followed by RT PCR using SYBR Green Supermix (ThermoFisher). Threshold cycles (Ct values) of qPCR reactions were extracted using QuantStudio™ Software V1.3 (Applied Biosystems, Foster City CA). Potential markers were normalized to housekeeping control sequences and to a spiked-in cDNA, the Cts determined and the relative expression calculated using the 2-ΔΔCt method.

Data analysis. For the initial analysis, the 95% confidence interval for expression (normalized to the described normalization sequences) of each of the selected T21 markers at 12 weeks gestation was calculated (FIG. 5, area between the dotted lines of each graph). Expression levels of the T21 biomarkers were then measured and plotted (squares) against the normal range for affected pregnancies at 12 weeks gestation.

The terms "sample", "biological sample", and the like mean a material known or suspected of expressing or containing one or more combinations of biomarkers. A test sample can be used directly as obtained from the source or following a pretreatment to modify the character of the sample. A sample can be derived from any biological source, such as tissues, extracts, or cell cultures, including cells, cell lysates, and physiological fluids, such as, for example, whole blood, plasma, serum, saliva, ocular lens fluid, cerebral spinal fluid, sputum, sweat, urine, milk, ascites fluid, synovial fluid, peritoneal fluid, and the like. A sample can be obtained from animals, preferably mammals, most preferably humans. A sample can be treated prior to use, such as preparing plasma from blood, diluting viscous fluids, and the like. Methods of treatment can involve filtration, distillation, extraction, concentration, inactivation of interfering components, the addition of reagents, and the like.

The complete disclosure of all patents, patent applications, and publications, and electronically available material (including, for instance, nucleotide sequence submissions in, e.g., GenBank and RefSeq, and amino acid sequence submissions in, e.g., SwissProt, PIR, PRF, PDB, and translations from annotated coding regions in GenBank and RefSeq) cited herein are incorporated by reference in their entirety. Supplementary materials referenced in publications (such as supplementary tables, supplementary figures, supplementary materials and methods, and/or supplementary experimental data) are likewise incorporated by reference in their entirety. In the event that any inconsistency exists between the disclosure of the present application and the disclosure(s) of any document incorporated herein by reference, the disclosure of the present application shall govern. The foregoing detailed description and examples have been given for clarity of understanding only. No unnecessary limitations are to be understood therefrom. The invention is not limited to the exact details shown and described, for variations obvious to one skilled in the art will be included within the invention defined by the claims.

A unique segment of a sequence in a sequence listing is a specific sequence segment that is found within the recited sequence of the SEQ ID NO, and substantially absent in the rest of the RNA transciptome. That is, the unique segment of the sequence in the Sequence Listing identified by the SEQ ID NO can be used as a probe or a primer that is specific for that SEQ ID NO. The techniques available for identifying a primer or a probe available to one of ordinary skill in the art can be used to identify one or more unique segments of each SEQ ID NO recited in the Sequence Listing.

Unless otherwise indicated, all numbers expressing quantities of components, molecular weights, and so forth used in the specification and claims are to be understood as being modified in all instances by the term "about." Accordingly, unless otherwise indicated to the contrary, the numerical parameters set forth in the specification and claims are approximations that may vary depending upon the desired properties sought to be obtained by the present invention. At the very least, and not as an attempt to limit the doctrine of equivalents to the scope of the claims, each numerical parameter should at least be construed in light of the number of reported significant digits and by applying ordinary rounding techniques.

Notwithstanding that the numerical ranges and parameters setting forth the broad scope of the invention are approximations, the numerical values set forth in the specific examples are reported as precisely as possible. All numerical values, however, inherently contain a range necessarily resulting from the standard deviation found in their respective testing measurements.

All headings are for the convenience of the reader and should not be used to limit the meaning of the text that follows the heading, unless so specified.

The present invention is illustrated by the examples provided herein. It is to be understood that the particular examples, materials, amounts, and procedures are to be interpreted broadly in accordance with the scope and spirit of the invention as set forth herein.

All references cited herein are incorporated herein in their entirety by specific reference.

SEQUENCE LISTING (3273 sequences)

SEQ ID NO: 1 - DNA, 2276 bp, Artificial Sequence
  Description of Artificial Sequence: Synthetic polynucleotide
gaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataatgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacaatctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatta

SEQ ID NO: 2 - DNA, 107 bp, Artificial Sequence
  Description of Artificial Sequence: Synthetic polynucleotide
gttcttgcttcggcagaacatatactaaaattggaacgatacagagaagattagcatggcccctgcgcaaggatgacacgcaaaatcgtgaagcgttccacattttt

SEQ ID NO: 3 - DNA, 107 bp, Artificial Sequence; identical to SEQ ID NO: 2
  Description of Artificial Sequence: Synthetic polynucleotide

SEQ ID NO: 4 - DNA, 107 bp, Artificial Sequence; identical to SEQ ID NO: 2
  Description of Artificial Sequence: Synthetic polynucleotide

SEQ ID NO: 5 - DNA, 19 bp, Artificial Sequence
  Description of Artificial Sequence: Synthetic oligonucleotide
gctttgggtccaggaatgg

SEQ ID NO: 6 - DNA, 22 bp, Artificial Sequence
  Description of Artificial Sequence: Synthetic oligonucleotide
gttgtccacagtcagcaatggt

SEQ ID NO: 7 - DNA, 16 bp, Artificial Sequence
  Description of Artificial Sequence: Synthetic oligonucleotide
agaccagcaagaagat

SEQ ID NO: 8 - DNA, 70 bp, Homo sapiens
ccatgggcaattggcagatcaagcgccagaatggagatgatcccttgctgacttaccggttcccaccaaa

SEQ ID NO: 9 - DNA, 76 bp, Homo sapiens
agtgggaccggctcttggtcctgtacccaacgtccttggccattttctccgaggagctggacgggctttgcttcaa

SEQ ID NO: 10 - DNA, 115 bp, Homo sapiens
gggcggcgctaggcctgggcacgctggcgctgtgcggggcggcgctgctctacctggcgcgctgcgcggccgagcccggggaccccagggcgatgtcgggccgcagcccgcctcc

SEQ ID NO: 11 - DNA, 106 bp, Homo sapiens
tggatacacctgcggaactggagctccgtggggctgcccgccagggcgcccgggggaccaggggcagcctcggcctcgcgcatttcctccgccatgcgcgccagac

SEQ ID NO: 12 - DNA, 46 bp, Homo sapiens
cagtccaggaagtctgttaggcggccgttctgggtgatgtaggaga

SEQ ID NO: 13 - DNA, 26 bp, Homo sapiens
gatgggccactcggaggggggctcac

SEQ ID NO: 14 - DNA, 77 bp, Homo sapiens
cagcgccagcgtgtagcctcctcccaggatccggagcaggagggtggctgtcttttgcgttcaatccgctgggctgc

SEQ ID NO: 15 - DNA, 26 bp, Homo sapiens
atctgtgaactcggcacagccctgct

SEQ ID NO: 16 - DNA, 176 bp, Homo sapiens
ctctgggactttcgagtcggttggtgcacttgcgggggcccagcaggggtacgttcgtgacgggctatttggcaaagacagccattctccccttctcctccggtaagagtctttgccagcacattgcgcttcttgtctctgtgtggcctggtgtggccgggccgtgtaaccaagct

SEQ ID NO: 17 - DNA, 91 bp, Homo sapiens
ctgtttgcggggacggtcggtgcagctgcaaggctggaggcggccggcaggtgcccggtgctggctgcagatgcggcgctaaccttctctc

SEQ ID NO: 18 - DNA, 129 bp, Homo sapiens
tataggtgatggtgcgcatggtcacggggtggccccggataaagaagcctccaaagtacacgcggtccaggctgtgcagccgtgcgtggaggcaggccagctgcccaatgtcgttgctgatcatgtgca

SEQ ID NO: 19 - DNA, 87 bp, Homo sapiens
ttcgttttggtgagcagagcgccaagcccccagaaggtgccgcctccaatggagctgccgccgacccactcgaacctgtcctccgtc

SEQ ID NO: 20 - DNA, 127 bp, Homo sapiens
aggactacgcccagatgaaccacatccaggtggagaagatagagccgtctgagctccctctgcccgggggcggcaaccgtagctcctccgtgccccaccccttccaggtgaccctgcttcgcaacag

SEQ ID NO: 21 - DNA, 52 bp, Homo sapiens
cccgtgtgatgccagactgcacacagcaaggctgccacgtccgtggcctcgg

SEQ ID NO: 22 - DNA, 115 bp, Homo sapiens
gccggtcctctcgcccatgaacaaggtgcacgggggcatgaacaagctgccctccgtcaaccagctggtgggccagcctcccccgcacagttcggcagctacacccaacctgggg

SEQ ID NO: 23 - DNA, 34 bp, Homo sapiens
gtgtcttctgctggaccggcaccttttgtttgtc

SEQ ID NO: 24 - DNA, 295 bp, Homo sapiens
ccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacag

SEQ ID NO: 25 - DNA, 27 bp, Homo sapiens
tgggtctcacagatgacgttcgggtcg

SEQ ID NO: 26 - DNA, 56 bp, Homo sapiens
aatgagggagtcagctccgtgctcctgggggcctccaatgcggaccagctcatgga

SEQ ID NO: 27 - DNA, 87 bp, Homo sapiens
cacacgcggcagaactccatgtggtcgtcctcctcctcctcgcagccgccctcctcctcttcatcgtcgtcgtccttcggctcccac

SEQ ID NO: 28 - DNA, 61 bp, Homo sapiens
ggtgcggcacagcgccgccgaggaggaggacgctatccacgccctcttcggcagcatgcag

SEQ ID NO: 29 - DNA, 66 bp, Homo sapiens
acaggcctcgcagaggttgaggggcccccggcggtgcagctgctggcagtcggcgtggtgacatac

SEQ ID NO: 30 - DNA, 624 bp, Homo sapiens
cggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactg

SEQ ID NO: 31 - DNA, 387 bp, Homo sapiens
acatgagtccgtttagagtcgcagtcttgggggcgaaggaccagggcgggagctggccgcagtccaccagcgaccacaggtcggtgtccgggtcgtagcactgcatcaccatggtctccttgccagccagggagccgatggcatagagccggccacggcacgcagtggtggagcagttgtccatggggtaggtcatgggctgcagggcctcccaggagtcagtggtgtggtcatagcgctcggtgctgtcggcggccaccacgtacagcagtccgtccagcacagaggagctgtggtactcgcgggccttcagcatgggcgccacctccgcccactcattcacgcttgagttgtacctccacacgcagtcatagagccgggagccat

SEQ ID NO: 32 - DNA, 97 bp, Homo sapiens
cactgctggtaccattgacagcgacggctgggacgcgggtttctcagacatcgcgtcctcagtgcccttgccagtctctgaccgctgctttagccac

SEQ ID NO: 33 - DNA, 1550 bp, Homo sapiens
ggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggc

SEQ ID NO: 34 - DNA, 29 bp, Homo sapiens
gagtccaactctggacccacccccttcag

SEQ ID NO: 35 - DNA, 29 bp, Homo sapiens
agtacagtgtagccgtgatgtggtcattt

SEQ ID NO: 36 - DNA, 108 bp, Homo sapiens
ccctctcccggcttcagaaagatgctgtggtggctgtgatgccaccggcagagagcatgctggggggtcacacaaagcaggagttggagatctgcaacaggcctggga

SEQ ID NO: 37 - DNA, 105 bp, Homo sapiens
gcaggtgggcttaatgctgatcttcaccaaaacatcttctgtggctcttttcttcccacagtcataggcagtgacggtcagcttatattgatgttctttcccgta

SEQ ID NO: 38 - DNA, 97 bp, Homo sapiens
tctgctaaccttgtccgaagctgacctggttgtttctttgcaaacaatctgatgacctctggggttttaaaggcctggctgatagctgcctgaatag

SEQ ID NO: 39 - DNA, 34 bp, Homo sapiens
atgatcgaagagaaaagcggagcctcagtgataa

SEQ ID NO: 40 - DNA, 83 bp, Homo sapiens
cttctttgcggttgtggttgccgaaatccttaagtcctggctgtgggcgggagctgcagagactctcttacttaggggctttc

SEQ ID NO: 41 - DNA, 280 bp, Homo sapiens
cggaacctccctgagaatcacattgacctcccaggcccagcgctgtggacgcctcaggccagccaccaccgccggcggggcccgggcaagaaggagtggggcccaggcctgcccagccaggcccaggatggggctgtggtcaccgccaccaggcaggcctccaggctgccagaggctgaggggctgctgcctgagcagagtcctgcaggcctgctgcaggacaaggacctgctcctgggactggcattgccctaccccgagaaggagaaccgacctccag

SEQ ID NO: 42 - DNA, 24 bp, Homo sapiens
gaaacaccgcggtaaactctccag

SEQ ID NO: 43 - DNA, 59 bp, Homo sapiens
tgccaaattccaccggaaccgcagggttacacggaggaaagggcgctgtgtggagcccg

SEQ ID NO: 44 - DNA, 102 bp, Homo sapiens
gcctacctggagagcctgccgctgcaggatgccagcccggccgggggcccctcgtcccccagggaccttcctgagccccgggtgtccacggagcacaccaat

SEQ ID NO: 45 - DNA, 36 bp, Homo sapiens
gagtaaacgatggaccgtgcggctggatatttctgc

SEQ ID NO: 46 - DNA, 87 bp, Homo sapiens
ccctggctgaggtacccgaacatgtgctgcgaggacttccggaggaagtgaggcttttcccttctgctgttgacaagacccggattg

SEQ ID NO: 47 - DNA, 179 bp, Homo sapiens
cggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcaga

SEQ ID NO: 48 - DNA, 26 bp, Homo sapiens
actttttaacatgcccctgtgaacag

SEQ ID NO: 49 - DNA, 41 bp, Homo sapiens
gtctgcaccggcaggcgcatcatggagcagacgcccaccgg

SEQ ID NO: 50 - DNA, 36 bp, Homo sapiens
gaatctggggtggtggcagtctcccctgagaaaagt

SEQ ID NO: 51 - DNA, 128 bp, Homo sapiens
tcccagcaccctcccgaggaggaagtgcattatcaccttcctgtcgctcgagccacagcccctgtgcagtcagaggtactagtcatgcagtctgagtaccgactgcacccctatactgtgccacggga

SEQ ID NO: 52 - DNA, 80 bp, Homo sapiens
tagccggccgccatgaagtgctccgtatactgctgcatcttgatggactccagccactcggacaccgtgcggaagggcac

SEQ ID NO: 53 - DNA, 52 bp, Homo sapiens
cccgcaggctcagcgtggccaggacgccgctgccgcgtacgtcggggatatc

SEQ ID NO: 54 - DNA, 67 bp, Homo sapiens
ggccagggccacgacacggtagccagcagctgtatagctctgcagcatctgggcgaagtcggtgggc

SEQ ID NO: 55 - DNA, 76 bp, Homo sapiens
tgacctggtagaaggcttgctgggtctcgatccagatatagcgctggccctggaagaggtaataccgcagcacccg

SEQ ID NO: 56 - DNA, 59 bp, Homo sapiens
caggctccgccaagggttgtggccggcaaccggcgcctcaaggagagggcgaccaccgc

SEQ ID NO: 57 - DNA, 70 bp, Homo sapiens
cttgctgtagaccttctcatcacggcagtcctccttgggcaaccagggtgtctctcggtcacagttcacc

SEQ ID NO: 58 - DNA, 24 bp, Homo sapiens
tgcggaacttcctgaaggcacagc

SEQ ID NO: 59 - DNA, 103 bp, Homo sapiens
atttctcggcatcccctatcttcactgacactgtggtgttccgagtggcaccctggatcatgacgcccagcactctgccacccctagaggtgtatgtgtgccg

SEQ ID NO: 60 - DNA, 99 bp, Homo sapiens
acgtgttttgtggatgcggtggcagagctggccaggaaggccggctgcaagctgaccatctgcccacaggccgagaaccgcaacgaccgctggatccag

SEQ ID NO: 61 - DNA, 26 bp, Homo sapiens
gggtcggagcccatctgatgaataca

SEQ ID NO: 62 - DNA, 26 bp, Homo sapiens
tgtacatctctgcccaggtattccca

SEQ ID NO: 63 - DNA, 44 bp, Homo sapiens
gattggcggagactcctgcaacctcatcggctccttccttgctg

SEQ ID NO: 64 - DNA, 29 bp, Homo sapiens
aggaacaccagcacgtggggagatttcat

SEQ ID NO: 65 - DNA, 103 bp, Homo sapiens
gccttctgtgaggccacgcacatccccatggagaagctcaagtggacgtcccccttcacctgccatcgagtgtccctcaccacccgcccgtctgagtccaaga

SEQ ID NO: 66 - DNA, 168 bp, Homo sapiens
gcagcttaatgtggagtggccttccttgggccacagaccagccaggggtgggcagtgcaggaagacctgctgtgggacccctgtgccaccccatggggcagggcagtgcttaggaagtggggccagtcagacagaggcacagttccttcccagctgatattgagcttc

SEQ ID NO: 67 - DNA, 25 bp, Homo sapiens
aacgggtttgaggttgtgaattcat

SEQ ID NO: 68 - DNA, 81 bp, Homo sapiens
gcagtgggagatgccgtgcgccgtgaggttgaggtcatggaagacgatctcctcgccctggatgcgcagctcccggacaca

SEQ ID NO: 69 - DNA, 27 bp, Homo sapiens
cttgcacactggggttacccacgtaac

SEQ ID NO: 70 - DNA, 193 bp, Homo sapiens
cagaccgatgtagcctggcgggcagcggcactcctccacctcgagggcgcggggtctgtttgagggccccggctgggcgacctccaggctgactgcgctgatgctggccgccagcggcacggaggagaacgtggcccggatcaggagctcatccaggtcggccagtgccatcaggaggtgctcgcgtgtggcc

SEQ ID NO: 71 - DNA, 101 bp, Homo sapiens
ggctgctgggcgtaggatgctcggatcaggagggtgtcgatgcctgccagtgccatcagcaggtgctcccgtgtggctggctgcccatcgggccgctgcca

SEQ ID NO: 72 - DNA, 32 bp, Homo sapiens
atgctgccacgctcgtcacagcgcacaatctc

SEQ ID NO: 73 - DNA, 91 bp, Homo sapiens
cgctccggtcaggacagtcgctctcctcgtcacagtggaagctggctgggatgcacatgttggtagagacgcatcggaactgtgtgggccc

SEQ ID NO: 74 - DNA, 36 bp, Homo sapiens
gatgaacaccacactgacaacctggtctccgggaat

SEQ ID NO: 75 - DNA, 27 bp, Homo sapiens
cccgcaggaagcccacggtgttcactc

SEQ ID NO: 76 - DNA, 113 bp, Homo sapiens
gaccccatgcactgtcctgtcacagccgcacttctccagctccccactgctgcacgcccgcgtcactgcaaaggccacacctgccgaagagatggcgtacacgaaggccgcct

SEQ ID NO: 77 - DNA, 195 bp, Homo sapiens
tgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcagg

SEQ ID NO: 78 - DNA, 121 bp, Homo sapiens
gccaccgcccatggactgcccgagcgccctgcaccaactcatgctggactgttggcagaaggaccgcaaccaccggcccaagttcggccaaattgtcaacacgctagacaagatgatccgc

SEQ ID NO: 79 - DNA, 30 bp, Homo sapiens
cttctcgatgaaggggaacaggctctgggc

SEQ ID NO: 80 - DNA, 30 bp, Homo sapiens
gtcaccctggcccgatcgcgctccttctcc

SEQ ID NO: 81 - DNA, 114 bp, Homo sapiens
atgacaaccaactctgaggccttggaggggacgctgctgcctaccctgctgatggctctcacccggaaccgatagctctgaccttcgacgaggccttggattgggcaccgacaa

SEQ ID NO: 82 - DNA, 70 bp, Homo sapiens
gacagctcggaggaggccgtcagagccagggctgctgccagggcgtagtccgcggcgctgaactcatgct

SEQ ID NO: 83 - DNA, 59 bp, Homo sapiens
tctgctgtatgtgcggagggagactgaggaggtgtttgacgcgctcatgttgaagaccc

SEQ ID NO: 84 - DNA, 64 bp, Homo sapiens
tcacagatgtacgactcctctttgattgccagtgtgggctacattctgtccacaaccattgcta

SEQ ID NO: 85 - DNA, 121 bp, Homo sapiens
tgctgaagtggcttgtggtgctgagtgagcctcgggggctgggtgtgctcggtgtcacccgcatgcgcagccgttccaggtccccaaagcggtcagggaacggcttggtctggtcctccag

SEQ ID NO: 86 - DNA, 41 bp, Homo sapiens
ccatcccgggcggcgctccggacgccctcccctcaccgcgc

SEQ ID NO: 87 - DNA, 165 bp, Homo sapiens
ttaaagtgctgtacagttaccacaaaaataaaataggaaactagcaccattctacctctcttctctccacacctgggttgtggggagatttgctaatcactgaaaaaaaagggtcaagagtaatcatcccaagcttaggctgatgtgggttaagatcagccagag

SEQ ID NO: 88 - DNA, 48 bp, Homo sapiens
tccaggaaggagtgttagcattttggtgcctggtttgattaaatgtgt

SEQ ID NO: 89 - DNA, 60 bp, Homo sapiens
aagagatcagagaatctatgcggagaaggtcttcttcttccagtgtggttgtagttggca

SEQ ID NO: 90 - DNA, 24 bp, Homo sapiens
ccaggactgaatttcaggctggac

SEQ ID NO: 91 - DNA, 31 bp, Homo sapiens
agggagctcaatcctggtagcaacacccctg

SEQ ID NO: 92 - DNA, 24 bp, Homo sapiens
tggtttttccccatcatcggccac

SEQ ID NO: 93 - DNA, 188 bp, Homo sapiens
gtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatg

SEQ ID NO: 94 - DNA, 26 bp, Homo sapiens
gcgagagacgcggccctcggggctcc

SEQ ID NO: 95 - DNA, 103 bp, Homo sapiens
ccttggctggatccccgtggtgcccatagacaagcgcccggacccgggcaggctcggcggatgcggagtaggaggaggcggcaggtccgtgacagccagaagc

SEQ ID NO: 96 - DNA, 73 bp, Homo sapiens
caacgcgggccagaacgcgtcgttccagtgcatggccgcgggcagagcggccgaggccgaacgcttcctcttg

SEQ ID NO: 97 - DNA, 25 bp, Homo sapiens
tctggactggggggcgaggccaggg

SEQ ID NO: 98 - DNA, 140 bp, Homo sapiens
gaggcagaagcctccgtacgccagtggtccttataacagcagtggtggccgtaaaagggggtgctgcaggggtgctgggggtggcggtggccactgtggcaggcactgtggccacagtcgggtcccctgtgcttgtggca

SEQ ID NO: 99 - DNA, 34 bp, Homo sapiens
tgtgcccacaggctggatgttcgtggtgggcagc

SEQ ID NO: 100 - DNA, 100 bp, Homo sapiens
cccgagtagaggtcatccagttcatcatcgggaaaggagtcatcatccccagagccctccaggtccacgggtctctcgaagttctcactgcgccagcgct

SEQ ID NO: 101 - DNA, 133 bp, Homo sapiens
ccacccccaacttaaagctgatctctgtgttcttgaaggtgctgtgtgtttttagggtgagaatgtccccattcttttcgatgattgtggtaggcttggtcatgctggccacctgcctggtagcaaaacccac

SEQ ID NO: 102 - DNA, 104 bp, Homo sapiens
ggcaagccagggctccccgaaggccccggagctccagggtggcctctctctcctgcagggcccggtggcccaacaggccccatggaaccactcttgccaggtcc

SEQ ID NO: 103 - DNA, 25 bp, Homo sapiens
tgggcgcagttgtcgaggcctggca

SEQ ID NO: 104 - DNA, 102 bp, Homo sapiens
caggcacactacggagggtccctgtgcctaccagccacagcggctccttggccctaggacttcctcatctgccatcccccaagcagcgggccaagttcaaga

SEQ ID NO: 105 - DNA, 55 bp, Homo sapiens
ggcgaagatggttacgtccgtatccattacttcgacccacagtacttcgaatttg

SEQ ID NO: 106 - DNA, 58 bp, Homo sapiens
tggggggcgcttggagccgccccgggctcgcgccgcaggggatagtacggcggggtcg

SEQ ID NO: 107 - DNA, 130 bp, Homo sapiens
ggtcacgccctcgctcctgcagatggtgcggctgcgctccgtgggtgctccaggaggggctcccaccccagcactggggccatcggccccccagaaaccactgcgaagggccctgtcagggcgggccagc

SEQ ID NO: 108 - DNA, 337 bp, Homo sapiens
ggcacaaccctcctagaggcgggacggtttcctgccaatcactgctggtttgccctccccctggtgttggcccggctgactcggggtaggggaggtcggggagggggcgataaaatggcgcagggggcggagtgaggcgcagtcgttcgcccaggctttggcccggcttccggaggtgaagagcgggagggacgagggggtcggcgttacccggcttggagggggatgggggcgcctgttgcttctccagggggttgcgcacgccgtccgccccttggagggattgggaggcccacgccctgctgcgagaagggcgcgttctagctcctgaggtgat

SEQ ID NO: 109 - DNA, 24 bp, Homo sapiens
tatctcaggagtgtcattgctcat

SEQ ID NO: 110 - DNA, 26 bp, Homo sapiens
tcagctgggacctcgacccgtttggg

SEQ ID NO: 111 - DNA, 206 bp, Homo sapiens
gtaaaagtgatgttgaagcccctcttccctgtggagtggtcagtctggaactcgagacgggccacgtggccactgcttgtgatggaggagggaagctggtttcctgagaaggtgcccaggacgggcgcctcggcggtggccccatccttgatgaccaggaaatcaaactgaggctccacgtcaatgtcgttgaaggccaggtggat

SEQ ID NO: 112 - DNA, 186 bp, Homo sapiens
agttcctaagcctcaccaaagagcactcgatcctggtcgaagagagttctggggagctggaggtacccggcagctctcccgaggggaccagagagctggctccctgcattcttgcccctcctctagtggcaggcagtaatgagcgccccagagcctccatcattgtcggagacaagcttctgaagc

SEQ ID NO: 113 - DNA, 105 bp, Homo sapiens
aaggcggccgcgaaggccaccgtggcggaggccagccccgagcttgcccagcggtgctccaggcagggaggggccaggcccgccagccaggcgaaggcgcaggca

SEQ ID NO: 114 - DNA, 62 bp, Homo sapiens
tggaggagggcgggcttacaaccacttggccctgagacaggggcaccgccgaagagtttgtt

SEQ ID NO: 115 - DNA, 247 bp, Homo sapiens
cttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgatta

SEQ ID NO: 116 - DNA, 69 bp, Homo sapiens
gactccgaagacagtcagccaggtttcggcgtgtgaagttagctgctgccgtgggagacaattcatatc

SEQ ID NO: 117 - DNA, 69 bp, Homo sapiens
catctcaagaacacatattctggcctacagcttattatcgtcatcctgccggggaagacaccagtgtat

SEQ ID NO: 118 - DNA, 103 bp, Homo sapiens
agtgcctgaccctgcgggaaagccggcgagacattgatgtggtgaaggaccctgtggaggatgagctgcataaagaggtggaggtcatcgaggccaccaagaa

SEQ ID NO: 119 - DNA, 94 bp, Homo sapiens
aggatctgcgcacaaagctcctgagcctgaagctgtcccatacccggctagaggccagaacctaccggcccaacgtggaactctgccgggacca

SEQ ID NO: 120 - DNA, 161 bp, Homo sapiens
ggcagtcctggcatcccatagccagtggggcctatcagcccaggggggccccgggtccctggctcccctttggcccctgatgggccctgtggtcctggcaaccctgctgcccctgggactcccacaccgtctactccaggaggtccttttgggcccacagc

SEQ ID NO: 121 - DNA, 63 bp, Homo sapiens
gaaggagaagagtgccctagcccgggagcgcagcctcaagaagcgccagtcgctgcccgcctc

SEQ ID NO: 122 - DNA, 53 bp, Homo sapiens
gaacaggcccggacaccggcaacacaaagcgaccgttattattctgaactttg

SEQ ID NO: 123 - DNA, 31 bp, Homo sapiens
atgaggagtgtctgccggatcagctggaact

SEQ ID NO: 124 - DNA, 97 bp, Homo sapiens
ctcccgggatgttctgggcccgcagccgttggtcgaggatgtaaagcatctccccgcccaagttcaagaagagcagcggtagcgtccgcaccgacat

SEQ ID NO: 125 - DNA, 118 bp, Homo sapiens
gcacttgttcatgtcggggttgcgggcgtcgaagtatccaggtgggcaggacggcaagcagacgcccacctggcggatgtcgttcctctccagcaggatgaacagcttgggtgagcac

SEQ ID NO: 126 - DNA, 73 bp, Homo sapiens
ttgtacaagatcttggtgttcgtcttttgaaattcggtcccaggccttgggcaaagcttgtatgtttgccaag

SEQ ID NO: 127 - DNA, 67 bp, Homo sapiens
acgtgcctggcgacttcttcgggtggtccccgtccgccctcctcgtccctacccagtttcttgcttc

SEQ ID NO: 128 - DNA, 25 bp, Homo sapiens
gggtggcgatgcgccgcccccgcca

SEQ ID NO: 129 - DNA, 118 bp, Homo sapiens
gtgctagaagataattctcagcggaccaaatggaaagtgatcagccccacagggaacgaggcaatggtgccgtcagtctgcttcctcatccccccacccaataaggatgccattgaga

SEQ ID NO: 130 - DNA, 47 bp, Homo sapiens
gactctctgagtggtagtagggaggccacgagaggccggagcattac

SEQ ID NO: 131 - DNA, 36 bp, Homo sapiens
agccctgggggacctttcattccgggtggacagttg

SEQ ID NO: 132 - DNA, 59 bp, Homo sapiens
tggaatgtgtggaccgaggctcccgcatggcctcctgttgtcgcttggcaaagaggctc

SEQ ID NO: 133 - DNA, 163 bp, Homo sapiens
cggagaggttcctcgtccgggctgggaagcgggcagaggcctctgccaggcagcccacagagctgctgcggtccagcggcggggtggcagaaggctcggggttggtcggtgcacgcggggactccaagcgggggctccaggactgcgctgcccggcgtccctg

SEQ ID NO: 134 - DNA, 72 bp, Homo sapiens
ggccgctccgtgcgtctccgcccccccgggaaaggtcccaacggtgcctactgcgagcggtcgaggccccga

SEQ ID NO: 135 - DNA, 38 bp, Homo sapiens
tggaccagatcgccgtcaccatcgtcggcggccacctc

SEQ ID NO: 136 - DNA, 24 bp, Homo sapiens
catccttgggcttcgattcactgc

SEQ ID NO: 137 - DNA, 24 bp, Homo sapiens
ggagaagagcccggttgcattttg

SEQ ID NO: 138 - DNA, 54 bp, Homo sapiens
tctctgtctgtgacaagggattcatcggattccgactccgaatccgagagcggg

SEQ ID NO: 139 - DNA, 51 bp, Homo sapiens
cccttggtgctgagtatccagcaagagtgaccggggtgaagaagcaaagac

SEQ ID NO: 140 - DNA, 180 bp, Homo sapiens
gacatctgaacagctgacccctgaggaagaggctgaggagacagaggcctgggccaagcctctgagccaactgtggcagaaccgacctccaaactttgaggctgagaaggaattcaatgagaccatggcccaacaggcccctcactgcgctgtctgtatgatcttccagacttatcatca

SEQ ID NO: 141 - DNA, 25 bp, Homo sapiens
agtcactgagcgaggacacagcctt

SEQ ID NO: 142 - DNA, 38 bp, Homo sapiens
ttctggaaatctgtggccactcgagtgcccaaggagcc

SEQ ID NO: 143 - DNA, 71 bp, Homo sapiens
tgctgcgtggatgtgctgggtgctgagcaagctggagctcaggctctcatacattttggccctgcctgctt

SEQ ID NO: 144 - DNA, 497 bp, Homo sapiens
gagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcacagcaacctaaata

SEQ ID NO: 145 - DNA, 56 bp, Homo sapiens
catcatcaaggaccaactgaacgtgtccaacattgaccaggtggccagacacctga

SEQ ID NO: 146 - DNA, 120 bp, Homo sapiens
gagccattactgcccacaatggggatctgcgccttgtccgggtgcagtggctggacctcgaagccgtcctcaggagagggggctatggtgggggcgtagcgccctgtccggtgctccagg

SEQ ID NO: 147 - DNA, 55 bp, Homo sapiens
tggcttcatcatgtgcagcggcaaagagaacccggacagtgatgctgacttggat

SEQ ID NO: 148 - DNA, 96 bp, Homo sapiens
ctgggacagaacaaggctcacaccccgttccgtgagagcaagctgacacaggtgctgagggactccttcattggggagaactctaggacttgcatg

SEQ ID NO: 149 - DNA, 128 bp, Homo sapiens
gactggagcagcaacggggcaaactgatagcgggcgaaatgggcaagattccagcgggcacagggcagggacttgcaggctgccttctgccttgtctcctcctcctggcctagaaggtcccgtgtgga

SEQ ID NO: 150 - DNA, 75 bp, Homo sapiens
atcagctgtccgatccattcatacttggcaaagtctcggcaggaggggttgggtacatacatgtcccgagcctca

SEQ ID NO: 151 - DNA, 38 bp, Homo sapiens
ctctattccgttcgctggttcgccacctcaggggaacg

SEQ ID NO: 152 - DNA, 89 bp, Homo sapiens
atcagaggaattatgtcgacggcggcttactccaaatctaccttctcctctgggtaggtgctctccgtgtttttcgaaggtggcagtag

SEQ ID NO: 153 - DNA, 25 bp, Homo sapiens
gctcgggccccgctagggccctcac

SEQ ID NO: 154 - DNA, 169 bp, Homo sapiens
agcgcttcaagcgcgccgagctgcccgcgcacgcggccgcggcgccagggccgccgctccccttcccctacgcgccctacgcgcccgcgcccggccccgcgctgctggtgccgccgccttctgccggaccgggcccctcgccgcccgcgcgtctgttcagcgtcgacag

SEQ ID NO: 155 - DNA, 192 bp, Homo sapiens
cggctacggctacgggctggctctcccggcctacggcgcacccccgccggggccggccccgcatccgcacccgcacccgcacgccttcgctttcgccgcggcagccgccgccgctccttgccagctgtcggtacccccaggccgcgccgccgcgcctccacccggacctccgacggcctcggtgttcgcagg

SEQ ID NO: 156 - DNA, 38 bp, Homo sapiens
agctggcccttctcagtgggaacaaccctctcttcctc

SEQ ID NO: 157 - DNA, 28 bp, Homo sapiens
tgcgaggcccgcgagctacaggcgcgcg

SEQ ID NO: 158 - DNA, 27 bp, Homo sapiens
ctttgccctcgcgacgccgccacctcc

SEQ ID NO: 159 - DNA, 55 bp, Homo sapiens
ggttcatttcttgcacccgggccacacgccccggaacatcgtccctcctgacgct

SEQ ID NO: 160 - DNA, 100 bp, Homo sapiens
ttccacgcatgagagcccggccgggggcacagggtctgggctgagggctctagcccctcagcaggcaggtggtcggagttgctaaacaccagtcgccagc

SEQ ID NO: 161 - DNA, 43 bp, Homo sapiens
gctcgcagggtgctggcgtagcccggtcgcgtctgcacgcgga

SEQ ID NO: 162 - DNA, 37 bp, Homo sapiens
cttggccaccttcgtggcccgccgagagatcaccaag

SEQ ID NO: 163 - DNA, 122 bp, Homo sapiens
cccagaaatcatgcaaggcatctacatgcagctgagccacatccaggagcctcgggcccgccaggtggccctgctgcccgtctccctcctggctagctccttcatgaccgaggttgtggtgg

SEQ ID NO: 164 - DNA, 29 bp, Homo sapiens
tcagaatgaggctttactccaggccatca

SEQ ID NO: 165 - DNA, 39 bp, Homo sapiens
ccgaggctgctgcggatagtggcgggtcggccccggctc

SEQ ID NO: 166 - DNA, 24 bp, Homo sapiens
cagtggttttgtactgttgttgct

SEQ ID NO: 167 - DNA, 24 bp, Homo sapiens
tagagctgcctacttaactgtctt

SEQ ID NO: 168 - DNA, 133 bp, Homo sapiens
tgcgctgttctcggagtccgacccagggcgactcacgcccactggtgcgacccggacagcctgggactgacccgccggcccaggcgaggctgcagccagagggctgggaagggatcgcgctcgcggcatccag

SEQ ID NO: 169 - DNA, 25 bp, Homo sapiens
ccgggaagagcccgtggatgttctg

SEQ ID NO: 170 - DNA, 46 bp, Homo sapiens
gtccaccaggagccggtgacatacacagctattgaccctggcctgc

SEQ ID NO: 171 - DNA, 298 bp, Homo sapiens
tcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgt

SEQ ID NO: 172 - DNA, 222 bp, Homo sapiens
gcactcaaatcagtcatggaacagccatcagtgcaacacaaagtttgtaaatcttgtcttgacatcactgaatgcttctttgacttccaaagctcttcagtgggcatctgtccaccccaaagacggtcttcccctgaggcatccaccttcggaaggttttgcgctggattttcctcagaaaactcacgtttatgtgggagctggaaggagtttcctgtctca

SEQ ID NO: 173 - DNA, 24 bp, Homo sapiens
catctgttgaatcttcaagtccag

SEQ ID NO: 174 - DNA, 62 bp, Homo sapiens
tgcaggaaaaagacgcctcctcacaaggtttcctgccacacttccaacatttcgccacgcag

SEQ ID NO: 175 - DNA, 24 bp, Homo sapiens
gatccagatgatgacctgtggcgt

SEQ ID NO: 176 - DNA, 250 bp, Homo sapiens
gcgaaccggctggaaagaaacaccgagtcactcgtacagactcttggtcgcagaacttggctttccgctattggtcctccagaaccgcttgaaacaactggccccagctggcgcatcagaccgcagtgaggaatgccgcggggcgggtggcgaaggcagggtctgcccgccagtggattcccgggtgtcccgcgtggagcaggcttgcccagctgggaagcccatcaaacctcagtcttggcccacagtg

SEQ ID NO: 177 - DNA, 25 bp, Homo sapiens
gcaaggtataaaacggagtctggga

SEQ ID NO: 178 - DNA, 28 bp, Homo sapiens
aggcgcgcccgctgctcggtggcaggag

SEQ ID NO: 179 - DNA, 122 bp, Homo sapiens
ggaccagaggacatcaaaattgcaaaatgtgtcaggtgattacagcggcatgaggtgtgggtctcatttgagtatgtcagctcacagccctctgaagaccagctgccattcatggtatcagg

SEQ ID NO: 180 - DNA, 26 bp, Homo sapiens
ttagtccttgttcaccctggtcacct

SEQ ID NO: 181 - DNA, 97 bp, Homo sapiens
agacccatggccttcgactacaaaaacatactaacaaagtcaaattaacatcaaaactgtattaaaatgcattgagtttttgtacaatacagataag

SEQ ID NO: 182 - DNA, 109 bp, Homo sapiens
cctgcccactggtaagcatcttcctctcttactcctctgccttccagagttggctgcaagggaggcctagtggcctggagcagggagaggacgggcagcagtccgggtt

SEQ ID NO: 183 - DNA, 25 bp, Homo sapiens
tgggaggtcaagttaagagtcaaaa

SEQ ID NO: 184 - DNA, 104 bp, Homo sapiens
gcctcgggctctatagagccgagcccgctgggtacccgcccggtaccgcggcgaggccagtgcccctggatcttgcctctgctccgacgccgttggggaccagt

SEQ ID NO: 185 - DNA, 27 bp, Homo sapiens
ggcgcaaacttggggtcgtcctcaggt

SEQ ID NO: 186 - DNA, 24 bp, Homo sapiens
gaggactcgttgaccttcttcact

SEQ ID NO: 187 - DNA, 27 bp, Homo sapiens
gatcaaggacagcgtcaccctcctgcc

SEQ ID NO: 188 - DNA, 139 bp, Homo sapiens
agtaagttctaatcacagtgcagcatacaatggcaccgatggcctggcaccagttgaagtagaggaacttctaagacaagcctcagagagaaactctaaatccccaacagagtatcatgagcctgtatatgccaatccc

SEQ ID NO: 189 - DNA, 39 bp, Homo sapiens
tcatcagatagaacccggaatagctcagcaaattcaagc

SEQ ID NO: 190 - DNA, 25 bp, Homo sapiens
ctttcgaccttgaaagactccctgg

SEQ ID NO: 191 - DNA, 114 bp, Homo sapiens
aagatcccaccggcagctgaacctccagctcaccttgtcaactccccgttatctgctcccctgagcccatcctctacaggcacctgcccccgccttccaggtccaaccctgaga

SEQ ID NO: 192 - DNA, 26 bp, Homo sapiens
tttctcctggcaccctgtattcatgg

SEQ ID NO: 193 - DNA, 126 bp, Homo sapiens
aaggagagggactgaacagattcttgacaagcctaggcataaatgctccaggtttgggaaagaggtaaaataaataggtggttactggggaggctccaacacagccagaagggacactgtttgctt

SEQ ID NO: 194 - DNA, 103 bp, Homo sapiens
ctgtgttcgccctgcagtttccgccttggcaggaggccaggcacaagactgacatatgggctcaaccagtgcctggccttgcctgtgtcacctttgtccagtg

SEQ ID NO: 195 - DNA, 54 bp, Homo sapiens
ttctgtcctggattaccctcactgcgtggtgcatgagctgccagagctgacggc

SEQ ID NO: 196 - DNA, 398 bp, Homo sapiens
gacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagc

SEQ ID NO: 197 - DNA, 106 bp, Homo sapiens
catcaacctcctgtcctttgacttccatgggtcttgggaaaagccccttatcactggccacaacagccctctgagcaaggggtggcaggacagagggccaagctcc

SEQ ID NO: 198 - DNA, 29 bp, Homo sapiens
tctgtgcacgaacaggtggccgactctgg

SEQ ID NO: 199 - DNA, 30 bp, Homo sapiens
cattggaggctggaacttcgggactgcccc

SEQ ID NO: 200 - DNA, 32 bp, Homo sapiens
gccggctcgccgagctggagaactttgcgaag

SEQ ID NO: 201 - DNA, 25 bp, Homo sapiens
ttgccgctatcgcaggcgccaggag

SEQ ID NO: 202 - DNA, 73 bp, Homo sapiens
ctgtacgaccggagtctggagtcaaacccagagcagctgcaggccatgaggcacattgttacgggcaccaccc

SEQ ID NO: 203 - DNA, 31 bp, Homo sapiens
agagaggccgcagtcgatcatagtcttcctg

SEQ ID NO: 204 - DNA, 105 bp, Homo sapiens
ccagaaaggatcctagaccgttgcagctctatcctcctccacggcaaggagcagcccctggatgaggagctgaaagacgcctttcagaacgcctatttggagctg

SEQ ID NO: 205 - DNA, 85 bp, Homo sapiens
gctttcttaagaccggcgtccgcgatggcccgaataaaggaaagagcttctacgtgtgccgggcagacacgtgcagcttcgtgcg

SEQ ID NO: 206 - DNA, 44 bp, Homo sapiens
cagattccccaggcgacggcttcgatgaaggacggcaaatggga

SEQ ID NO: 207 - DNA, 77 bp, Homo sapiens
ctttgcccagtgcaagaagggggtgcgtgtggtgaactgtgcccgtggagggatcgtggacgaaggcgccctgctcc

SEQ ID NO: 208 - DNA, 81 bp, Homo sapiens
gacgccgggcatactttcggcgatgctgctcgtccactcgctccaggtaccaagtacctgggaaaaggctgtttgtgtcac

SEQ ID NO: 209 - DNA, 900 bp, Homo sapiens
actgtgactgggtgttcgctcagcagcatttgaggaagcataactgtgctgtgaagggggtgtggggtacttgcccacagaggctgggaaaggatgataggctgggagaatggtctgagctacctgcccgtcctgctggggcatcatggcagtggggaaagccacactgggcaaacgggccatttctggaatctggtacatggtgggcagggggcccgcaacagctggagggcaggtggactgaggctggggagcccccgctggttgggcaatactgcctttagggatgagctggaaagtcacaatggggggcaagggctcccgaggggtggttatgtgcttcccttcaggtggcctgctctggggagctatgccaggatgggtgccctcagctggagccaggaccataccaaacatctcattgtactgggtctcattcacctccatgcggttcatccaatctgctgggactgggactggatggagcctactcaagcttccagcactgccactgcctggagacacaatgtggtggtgggatagcaactggctcactgagggaagcacagtgctggccccatgtgccaaaggctgcatttcatgaaggttagaaaaagatagtgcatgctgggcatggactggggcaggaggggcggcagtggccaacatagggttgggtgaggcctgtaagatcccaggggatgtaatcattggagaggatgtggtgtcggaaacatacgtgtgaggagattctagggaatcaacaggggataaagttactgaactctcagacagttggaccttctcactcagagacttcttcctcctactacccttggcatcctttgcctccttggcaaggttagggaggctagtaggcatggtactcttggcactggg

SEQ ID NO: 210 - DNA, 24 bp, Homo sapiens
tgcaagatcctccgctgcaatgct

SEQ ID NO: 211 - DNA, 33 bp, Homo sapiens
tggacgcctgggtccgcttcagtgctcagagcc

SEQ ID NO: 212 - DNA, 49 bp, Homo sapiens
cagccagcaaacaacgggtggactccagattccgaaaaatgttagtgga

SEQ ID NO: 213 - DNA, 29 bp, Homo sapiens
ccatggctggccgcgtttgtttgtgccag

SEQ ID NO: 214 - DNA, 79 bp, Homo sapiens
cagaggagatagcaggtcgagggagccaacgagaagagactgccagcagggaaggactgtcccgccaaggacagagctg

SEQ ID NO: 215 - DNA, 24 bp, Homo sapiens
tgatcctcaagtactttcagccag

SEQ ID NO: 216 - DNA, 24 bp, Homo sapiens
atcaggtggtctattattatacag

SEQ ID NO: 217 - DNA, 130 bp, Homo sapiens
gaccgggagtatgctgtgaagacccaccaccacttgtgttgccgccaccctcccagccctactcgggatgagtgctttgcccgtcgggctccttaccccaactatgaccgggacatcttgaccattgaca

SEQ ID NO: 218 - DNA, 72 bp, Homo sapiens
tgaaattctctgccggccggggggtaggagggaatgtgttgccctgggagaatagctgttgggtggcaggga

SEQ ID NO: 219 - DNA, 105 bp, Homo sapiens
ccaaacatgtgcacaaaccggttggtgcaacatggactacaagttcggctacagctattcaagacacagaacaagggctggggtatccgctgcttggatgacatt

SEQ ID NO: 220 - DNA, 29 bp, Homo sapiens
tggcaccgtccctcacccaggagatcctc

SEQ ID NO: 221 - DNA, 90 bp, Homo sapiens
agaggatgttcatgatggcaaggagagggcaagggccgttagtgctctgggtgatgatgggtgtctgttctcctttccaagggatccact

SEQ ID NO: 222 - DNA, 72 bp, Homo sapiens
agtcccgacctctacatgttgtgctgggaaatgaagcctgtgatttggactccacagtgtctgctcttgccc

SEQ ID NO: 223 - DNA, 24 bp, Homo sapiens
acagccagacttcgagcttccaag

SEQ ID NO: 224 - DNA, 162 bp, Homo sapiens
accaagggaattttatcttctgcttctttggtatgctgggaaccggggccccttcctcctttggaaacagtaccatctccctgaccctgggcaagtactgcccccttttcagcctctcccattggccctggcctctctgcccctccagctgagttgccttcc

SEQ ID NO: 225 - DNA, 106 bp, Homo sapiens
gccaccaagccttcgagctttgatgtcagggaagatctctctgatgatcttgccaaagttggctgtgctgagtgggcggcaacaggcaagactctcacagtacttc

SEQ ID NO: 226 - DNA, 103 bp, Homo sapiens
ggacctgaagacccggttggccagctcagaaggcttccagaagcctagtgccagcctctctcagcttgagtcccagaatcagttgttgcaggagcggctacag

SEQ ID NO: 227 - DNA, 130 bp, Homo sapiens
tttgaagcgtcaggtggatgaagcagaagaggaaattgagcgactggacggcctgaggaagaaggcccagcgtgaggtggaggagcagcatgaggtcaatgaacagctccaggcccggatcaagtctctg

SEQ ID NO: 228 - DNA, 34 bp, Homo sapiens
gctgctccagtcagccgtcgagtgcgccgcctcg

SEQ ID NO: 229 - DNA, 423 bp, Homo sapiens
cacacagcgccttgggtgagtgctgctccactcctgccttcctgactcagtgcttgccccagtctgggcctgtcctcccggtactgtctctcctgcctcagggttgctcacttgcatccatctttgaccactgcctggctgcgtctgggtctgtccctgttctctagcccctccgtggcttacagtttggcttctgtcctgctccacagtctcggtgtgtgaccctgcctgtatctgagtgtgtcctcctgtcacagcctggctggtctggctcctgccttgaccgtggatctcagtccctctgttctggccattggtggactcctgtgtctgggtgctggtgcttcctgtctggtggctgctgtcctgctccacggtctgggtgggtgtctgggtgtgtgtccctgcctgtatctgagcatg

SEQ ID NO: 230 - DNA, 44 bp, Homo sapiens
cccaggtgggatgaaacaagtggctgttaagtggtgtgaggagt

SEQ ID NO: 231 - DNA, 132 bp, Homo sapiens
ttggagaccaagcctgaagtctcaccccttaacatggagtctgagcccaactcaccgcaaactcaggacaagggctgtcaaacccagcagcagccccatagcccacaaaatgagtccaggccaagcaaatga

SEQ ID NO: 232 - DNA, 36 bp, Homo sapiens
aaagcctgcccaggagacaaggttcgggccacatca

SEQ ID NO: 233 - DNA, 27 bp, Homo sapiens
tttgaaccagacgtctgcacccttttt

SEQ ID NO: 234 - DNA, 151 bp, Homo sapiens
tgcccccggaacagggcgctgctccatggctctgcttgtggtagtctgtggctatgtctcccagcaaggacagaaactcagaaaaatcaatcttcttatcctcattcttgtcctttttctcaaagacatcggcgaggtaatttgtgccctt

SEQ ID NO: 235 - DNA, 78 bp, Homo sapiens
aaacatggccgtacagtaacctgctatacattctttcagacacacacactccagcgtttgtcccttatcactcattaa

SEQ ID NO: 236 - DNA, 66 bp, Homo sapiens
tgcactaggatgcggggtctctgtggggaagggaagggaacgttgtgaatgaagtgggagatgtgc

SEQ ID NO: 237 - DNA, 58 bp, Homo sapiens
gagctgtatgggtatgggggtaaccgctggtcagtggacagtttactggtatccaggg

SEQ ID NO: 238 - DNA, 123 bp, Homo sapiens
ctcaggaagatttactatagctaagagaaaactgcagcagaaagggcgcggctacctacttcttaaattccgtttgtggaccctcagactcttagtcccctactcccagatacagcggcccta

SEQ ID NO: 239 - DNA, 49 bp, Homo sapiens
cactgtgtcatccacgacgcctggagcggcctgaggcacgtggtgcagc

SEQ ID NO: 240 - DNA, 95 bp, Homo sapiens
ctggggtctgacaatacctcgagccacaaccgaccagatgccagggacccacggagcccttatgacatcagcaatacagactacttcttccccag

SEQ ID NO: 241 - DNA, 31 bp, Homo sapiens
cagcgacgacttctggaccatcccacccctg

SEQ ID NO: 242 - DNA, 172 bp, Homo sapiens
acaggtttgactagcgaactgggcatattctaacagcccgctgatggggttcttcagctggcactctgtcagtttcttgtagggtgaacaccgtggcaagccatgactgtagaaggagggcatctccatgatggctcgaaactcacctggtgctgcgcggatactattcaag

SEQ ID NO: 243 - DNA, 141 bp, Homo sapiens
tgtctatagacatccccctgcctttccatgtcaattagcacagcatttatatctcgggccttggtaaggccaatatttttagccaaattcagggcagaggagtcagacacattgaagagatagtcgcagattttctccttg

SEQ ID NO: 244 - DNA, 136 bp, Homo sapiens
cctcacggatgtagacagactggatctccttggtcttgaggcagagatcgcaggcccagacggcagaagcttcagtggtcagcagcccataggcgctctcagtcatgcctgtgcactcacggtggaaccatttctg

SEQ ID NO: 245 - DNA, 112 bp, Homo sapiens
cttagcctggttggacctctgtggcccaggagtcacagaagtcctggggagggagagggacaagtggcttccgctccccagctcagacccagacagtttcaggccccatccc

SEQ ID NO: 246 - DNA, 56 bp, Homo sapiens
agtgggggctcctttagtggcggaggatgtctcaggtggtctgtggggctcagggc

SEQ ID NO: 247 - DNA, 29 bp, Homo sapiens
cctccgcgcgctgttccgcacttgctgcc

SEQ ID NO: 248 - DNA, 34 bp, Homo sapiens
accgcctccgacagtgtcctcgctctacctctga

SEQ ID NO: 249 - DNA, 173 bp, Homo sapiens
gcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgc

SEQ ID NO: 250 - DNA, 74 bp, Homo sapiens
cataggatggtaggtatcccgggctggaaagatgtccagctgcccgtagttctttcggcggcactgacagacag

SEQ ID NO: 251 - DNA, 45 bp, Homo sapiens
cagctaccatctgccgagactcgcccacagtcagcaggtcaatta

SEQ ID NO: 252 - DNA, 32 bp, Homo sapiens
taaccggtgccagaaaggcaagcaatcaagca

SEQ ID NO: 253 - DNA, 97 bp, Homo sapiens
ggagaggccggtgcacaggaaggagttgagtgcggcggcaggcacaaagaactggtgcaggtggccgtgcagccaggaggccggcatggagtaggcg

SEQ ID NO: 254 - DNA, 178 bp, Homo sapiens
accctgaccctgctactcggtgcaggccactccaggccttgcttctctaacagcccctgtggctggctccagagctgcctggtccccataaagggggctgaaaggaggatgggtgatccttgaggaggggaagggtctgcagagaatcactcagacaccaggtattacccagctcttc

SEQ ID NO: 255 - DNA, 80 bp, Homo sapiens
gagcaggggccgatccgtgtcaaagttaaagcgtctgtgggcagctcggagcgggggcaggttacgaagagccatgtcct

SEQ ID NO: 256 - DNA, 155 bp, Homo sapiens
taatttatggactggtactctgagtacttcttgtggtgcagcagcagaaccaagccgccccctagcagcatgagccctggggcacccagggccactgccatgatgcccaggactagtggggacaagccgtccactggagggaagcccacacccag

SEQ ID NO: 257 - DNA, 129 bp, Homo sapiens
cctcccgggtcaggtgagaggtgttgagggggcagccaggaggttgctcccagatcccctggaaggtctgcagatggaagtagtaggcagtgccatccttcatgtcatgttgaacccagaaagctgtgt

SEQ ID NO: 258 - DNA, 25 bp, Homo sapiens
tgagttaggtagtggtcatagatgt

SEQ ID NO: 259 - DNA, 39 bp, Homo sapiens
ccaaggctcaactgccctctctatcctactccttttctt

SEQ ID NO: 260 - DNA, 104 bp, Homo sapiens
attcttctgacaggtcagagtcacggccacactcctcttctccctcctccccctcctccttttctgagggtggggcctcaaggccctcggaagccaggacagca

SEQ ID NO: 261 - DNA, 72 bp, Homo sapiens
acttctggagatctcagtggctcttgattctccttttccagagctgtcaatgactctaagttctcttgcaga

SEQ ID NO: 262 - DNA, 30 bp, Homo sapiens
ggcccaggagaaccgtgtggtggccttctt

SEQ ID NO: 263 - DNA, 25 bp, Homo sapiens
tgcctccttgggacgtttaggagag

SEQ ID NO: 264 - DNA, 161 bp, Homo sapiens
aactcaatgcattcccgtgggctggccagctcattcaccgtcttcagggccacgggtgtggactcctctccagcctcaagtcctcgtgccagcccctcatataccatcccaaaagagccctggcccagttcccggattatcgagatctgctcccgaggcac

SEQ ID NO: 265 - DNA, 46 bp, Homo sapiens
tgcagtgtcatgggcaagggcccctggcccacatgcccaatgccag

SEQ ID NO: 266 - DNA, 71 bp, Homo sapiens
cttctggcgcggtgaccaaaaagggagagcgcgcggccaaagagaagccagcgaccgttctgcctcccgtg

SEQ ID NO: 267 - DNA, 94 bp, Homo sapiens
cagtagagcagcagtgcccccgcagcaaggcctgctatgctgagcaggcccccggcgactcctgtggcaaaagggccacttctgttcgcggtca

SEQ ID NO: 268 - DNA, 96 bp, Homo sapiens
agacgtatcagtgcaagccaaactcagcacaggagggaagtcacaaaagacgtgctgaatgcgattggggccacagaatgggaggcgtgaaatcaa

SEQ ID NO: 269 - DNA, 46 bp, Homo sapiens
aggaacccagaaacgggatggttgtcggcaaaggttgggagtggct

SEQ ID NO: 270 - DNA, 26 bp, Homo sapiens
cggagctctccccctcaactgagaac

SEQ ID NO: 271 - DNA, 26 bp, Homo sapiens
ccgcaccgctcggctccactctcgcc

SEQ ID NO: 272 - DNA, 79 bp, Homo sapiens
ggtgatggcgtctctgtctcaggtgatgcataaggaaccacagcatgtgactatcaaacaggtcagtttggtgcaagct

SEQ ID NO: 273 - DNA, 179 bp, Homo sapiens
tctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctg

SEQ ID NO: 274 - DNA, 62 bp, Homo sapiens
gccagagtccggtagcacctgagtaaggcaaatgcagatgataggcggtgagccgaccaggc

SEQ ID NO: 275 - DNA, 50 bp, Homo sapiens
aagacgactccgggatccagacccttctgcaccttcagatgggagctcca

SEQ ID NO: 276 - DNA, 40 bp, Homo sapiens
ccaagagaacaggggcatagacagccgtctggactgggct

SEQ ID NO: 277 - DNA, 29 bp, Homo sapiens
aacattaatgacctcaaactcacgttgtc

SEQ ID NO: 278 - DNA, 25 bp, Homo sapiens
tttgtccagggaatcacgccactgc

SEQ ID NO: 279 - DNA, 167 bp, Homo sapiens
catagctatgtcaatgtccagggaagcatttttaaatagtaaatcagaaacatgtaaactagtgaatacaattttctatttttcattcagaaatttgttgtcatagatgcagcctttatctggaaatcagtgggcagctctggtcaagcacagcatggcgaccactg

SEQ ID NO: 280 - DNA, 155 bp, Homo sapiens
ccattggtcacttaagagcactaacccctccctggtttgaagatgttcttgactttaaatacaaacatctgatattccagcttagactcctccacaagaactagagtgtcatcctattttggcttccagctcagtccctctgctacaagtcttga

SEQ ID NO: 281 - DNA, 47 bp, Homo sapiens
tggggaaagggacatctgaccaaagtttggggaaagatctgtctcac

SEQ ID NO: 282 - DNA, 116 bp, Homo sapiens
ggtcatcacgtttcacctcatcaggattttcacaaaacttgttgatgttgtcctcaaggtaccagcttttgttctcatcaaacacagcaaacacagcctgctgttcgatgtctgct

SEQ ID NO: 283 - DNA, 108 bp, Homo sapiens
gctcaggtcggtagctccaactgatgccctgagcagccacgtagaactgccttagctgtgccgcttctgtcccttggctcccccagcctacccagctggtgcccaaga

SEQ ID NO: 284 - DNA, 156 bp, Homo sapiens
agcccgggaatcttaaggccgccgccggggttggagggtctgcgacgcccaaaagggcagcgcccgcccgcagagtggggctgggaggggacggggtagggtagggtgaccccagggtgcgccttcactcttctggcaccccatttggctttttgg

SEQ ID NO: 285 - DNA, 37 bp, Homo sapiens
taggagatgaattggggatttgctagtaaaatgatac

SEQ ID NO: 286 - DNA, 103 bp, Homo sapiens
caccgtctgtcttgtggtcagtcaccctacaccgagacaacaacgtgggagcggaagtattgcatcctcacagacagccagttggtattgctcaacaaggaga

SEQ ID NO: 287 - DNA, 42 bp, Homo sapiens
tgatgaatgaccctccaacagccccacatgggttgtttctgt

SEQ ID NO: 288 - DNA, 58 bp, Homo sapiens
aatcgtaaaactgttagtatcaggagagcccttcgagtattctctccgctccacaccg

SEQ ID NO: 289 - DNA, 198 bp, Homo sapiens
gtgtggcagtccatccatctgtcagcagccactgcgggcctacttgctgggtgcccagcaccgcactcaccactgcaggcgtggccaggagcgtgagatccccagagcccatggccagtgagaggcggccagggataggtacccagggtatgccacaggagtttgctgggctcacggagctctttcactggtcagaga

SEQ ID NO: 290 - DNA, 107 bp, Homo sapiens
gcgcgtcaccagagtcgtttctcttcggagtcttaggtgatcgagggtgtgcccagggggcggacttgtttgcgcctcccgttccctcccaatttccaaacgtgtca

SEQ ID NO: 291 - DNA, 59 bp, Homo sapiens
gcgccagcagcagattgagcgtgagctgaatggctaccgtgcctggatagacaaagcag

SEQ ID NO: 292 - DNA, 99 bp, Homo sapiens
acatgggccgggtcatcagccagagcgagcctgacctctcctgcatcacggccaacacggacaaggccaccaccgagagcaccagcgtcaccgtcgcca

SEQ ID NO: 293 - DNA, 28 bp, Homo sapiens
ggaggccgcagtactgctcacacgctcc

SEQ ID NO: 294 - DNA, 250 bp, Homo sapiens
caatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcagga

SEQ ID NO: 295 - DNA, 286 bp, Homo sapiens
gcactcgggcacgcgctcggaagtcgggggtcggcgcggagtgcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtg

SEQ ID NO: 296 - DNA, 102 bp, Homo sapiens
cctggcccagcagttgacaagggaggccactcaagcggaaattgaagcagataggtcttatcagcacagtctccgcctcctggattcagtgtctcggcttca

SEQ ID NO: 297 - DNA, 73 bp, Homo sapiens
cgccagcacccgcggtgccgcggggccgctccgaggagcctgagagacccacggaggcttcgcgggaagacgc

SEQ ID NO: 298 - DNA, 51 bp, Homo sapiens
ggctttggaactaggaggagctgggatgtcggactgcggagagctttcctc

SEQ ID NO: 299 - DNA, 296 bp, Homo sapiens
aaagatgctatcgaacatgcgcacatcccccaacagtctgcctcctgcgattgcttttcacagtatccaaagtgtccatctgtctgcttgtcttcgagttaccctccttgttcatatgggtcctagtcttctgaaattttccctttctttcattttctctctttcgttaaacaaaagagctgtagttgcccgttctgcttgtagcactgttgactcttcccgacagttgatgcattgaagctttttacatctgctattttcctggctggacaatgcagtgctgtgttctcgtctca

SEQ ID NO: 300 - DNA, 85 bp, Homo sapiens
tataaaaccagctaatgtgttcattacagccactggggtggtaaaacttggagatcttgggcttggccggtttttcagctcaaaa

SEQ ID NO: 301 - DNA, 85 bp, Homo sapiens
atgggcacggccttctctttcagctgcagctcagccaggggacgtggtcgggggctcagcgggatctcaggctcatcttcctcgt

SEQ ID NO: 302 - DNA, 86 bp, Homo sapiens
ttgccacagacgaaaaggatgatgaagtaaatgcacacaagcatgccagggtaggacggcccgccgtaggccatgatcccattgta

SEQ ID NO: 303 - DNA, 24 bp, Homo sapiens
agaaggatcccagcaaaatgaggg

SEQ ID NO: 304 - DNA, 28 bp, Homo sapiens
caatgcccccgccttggggactaggctg

SEQ ID NO: 305 - DNA, 225 bp, Homo sapiens
cacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccat

SEQ ID NO: 306 - DNA, 220 bp, Homo sapiens
ccgactcagtctccggcgaggtgggatttccagttccttcttggagactaggggtttctgtgtggcctgcacagggctcaagctgttcctcccctcctctgcctccagcctctcctggatgggggcctgtgcagcctccaccacctgccgcctctgcctccgctcctgccgtgttctgaggatgctctggatgtcctcgtcctcatctttggaggctggg

SEQ ID NO: 307 - DNA, 1145 bp, Homo sapiens
attcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttg

SEQ ID NO: 308 - DNA, 94 bp, Homo sapiens
aggagggcacccaaacattggacgaaccagtgtcaaagacgactttgaaggtctggggtggggtgccgatgccaatctcgccatagtactgggt

SEQ ID NO: 309 - DNA, 1402 bp, Homo sapiens
gaagatcggtggaatcctcccaggctgtaatccctcagaaacatgagaatatcctaagcacctacaacagtgcctggtacataaaaggtgctcgataaatatttgttgagtaaattgtcatctttacttgcatatgaaccagtaactgtcccagccatgaaggagtgcagaggaattagtaggtgttcttgggaccgctggaagtcaggctgaagcctctgagcggcaactctagcagagagaaggccgaggggccacggtgtcttcagtttccctccttcctcctctctggctacattcgtctccaggtgggtggagctgaggaggaatgcgtttgcttttctctgtcttccccgctgccctcccggggcaggtggatcatgagagcgcctagcctcagccagtcctcgtctgggatgcctgggatagggggataggcctcccagattaaggcctcatcccccctcctcaaggcgtactctcagctggcccactgcacattccagggggaacagggcaagaaatatcatggaactgggtaggtaaggccccaaggctgaccacaccctacataagacaagtccttctctctgccccttaccccaggatggcgaggcagacaccaggcacagacctactaacagccatctcccaggcagtcgctactcaacccccttcacccagatccccacaccaagcatctccactgaggctgcatgtgctccactggtgggtcctcctagggatgaggtgggaggagcagaggagacagtctggcactgcactgggcactaacctaaggctccaccgggggaaaccaatctgatatcccctttccatctccctccttcctgcttgacttgccaatgtgtcctgctgcttccccctccttccactctgaggatctctctctctctctctctctctctctctttctgtctctctctctctgctacccttcccaacctgccctcagacactgcacagacctgctgttctctagccacagccagcactgttccctctgggagccaatggcctctccccatctctcatcaccttgtctttggctcaagcagggtggtcagtctccaccggaccccagcgagcacccataagcaaagcactgggtttgtgtcaaagccctgggtccagctgaggcagtagggtggggctgacgaggatagggatgatgacaagtgctgtccttggtgtcaggctggctccagaggcagtgtccatctcctcttcacctctagtcctcacataagatagccacaggtgtgttctccaccacggcatgtcccccatcagggaatgttccactggagtcaccacaaccccagccagggcaaggctgaggctccctgtgacttggacattaatgaggatggtgctcccc

SEQ ID NO: 310 - DNA, 105 bp, Homo sapiens
ctgcctctacctcttgcctggtgggcacaaggctgatgtctctgggggtgtccaggggcaatgtctggtgggggtctttcttgctttgttcatagtttgccttgg

SEQ ID NO: 311 - DNA, 205 bp, Homo sapiens
tgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggtta

SEQ ID NO: 312 - DNA, 29 bp, Homo sapiens
gcgggggagagatccttatcccctgccag

SEQ ID NO: 313 - DNA, 48 bp, Homo sapiens
tgaaccaggttgttcagcccttaatgagcagacactctgcatgtagag

SEQ ID NO: 314 - DNA, 65 bp, Homo sapiens
ttgcctgggcaaagaggactgcgtcatgtatgctgggaaagacgtgcttgcattctagactccca

SEQ ID NO: 315 - DNA, 57 bp, Homo sapiens
aggaaccacctgcgcctggttggctgttctgtggctgcctgtaacacagaagcccag

SEQ ID NO: 316 - DNA, 26 bp, Homo sapiens
cagcagggggcatcaccagtccaggc

SEQ ID NO: 317 - DNA, 149 bp, Homo sapiens
cctagatcggggtatatgttaagggattacgaaaatctaggactttttgtggggctttttattaaagggggggagcccgggagcaataccttggaaagaagccctgttgcttagagcggataaccaacggctgaactcttggggtttgc

SEQ ID NO: 318 - DNA, 41 bp, Homo sapiens
cccgagcgccgcaccactcaggccgacttctcctgtgcaat

SEQ ID NO: 319 - DNA, 24 bp, Homo sapiens
tggtatgcggtggtgtgatcgtag

SEQ ID NO: 320 - DNA, 24 bp, Homo sapiens
ctggcgctttcctgggttgcttct

SEQ ID NO: 321 - DNA, 24 bp, Homo sapiens
agtaatttgtgttgtcccgtacag

SEQ ID NO: 322 - DNA, 49 bp, Homo sapiens
acagattctttgccattgaatttgactcggatccttggctcctgaatga

SEQ ID NO: 323 - DNA, 24 bp, Homo sapiens
ggacatctatgagagcaccaccca

SEQ ID NO: 324 - DNA, 52 bp, Homo sapiens
ggctttgcccgtgtggagtccaaagtccttccctaacgaagtggagcctgag

SEQ ID NO: 325 - DNA, 135 bp, Homo sapiens
tactggggaagaaccgatcggccaacggcagcgccaagagcccggcaggcggcggcggcagcggcgcctcgtccaccaacggcgggctgcactactcagagcccgagagcggctgcagcagcgacgacgagcacg

SEQ ID NO: 326 - DNA, 30 bp, Homo sapiens
catccagttcctgttcgccatagccggcat

SEQ ID NO: 327 - DNA, 51 bp, Homo sapiens
tgctcttcaattcggtgctccgccagccccagcttggcgtcctgagaaatg

SEQ ID NO: 328 - DNA, 106 bp, Homo sapiens
gcgcgcactgcacagctctcttctctcgccgccgcccgagcgcacccttcagcccgcgcgccggccgtgagtcctcggtgctcgcccgccggccagacaaacagcc

SEQ ID NO: 329 - DNA, 73 bp, Homo sapiens
tgctcctgttgtacgtcctcgactccaatcactatatactgaacctccttcatgcgaggctatcactcgatac

SEQ ID NO: 330 - DNA, 81 bp, Homo sapiens
cgccggggccgcttgttgcaccgccccgcggcctgcgggagccgctcgccccggccttgtgctcgcgtccgcacccctttc

SEQ ID NO: 331 - DNA, 40 bp, Homo sapiens
ccggacgccattgccgacggtgaacgagcgggacacggaa

SEQ ID NO: 332 - DNA, 121 bp, Homo sapiens
tgctgctcccgagcttttccaaggaaagaagtatgatgggcctgaagtggatgtgtggagtctgggcgtcattctctatacattagtcagtggctccttgcctttcgatggccagaattta

SEQ ID NO: 333 - DNA, 48 bp, Homo sapiens
ggaggtctcaggccccttgggcagacgctgcgcgtgcccagagggagg

SEQ ID NO: 334 - DNA, 128 bp, Homo sapiens
ctgtattttcatcggcccctctgaagcctgaatgaccaaggaaccatccggcagggctggcttcaccagcaattcaggccttgagggcatccgaggcatagtagacgactggatatagggacctactg

SEQ ID NO: 335 - DNA, 172 bp, Homo sapiens
gctggatgccagcgggacctcagacctggactgcagcatctctttggttatcggttgtgtgtgtgctcagaagggaggaggccttccccttgttacatctctctctccatatattctcccggactcatcagtttggggggcgaaaagtccaccacatggtcttggcgacaaa

SEQ ID NO: 336 - DNA, 24 bp, Homo sapiens
gcagacggaagatggcagtcagcc

SEQ ID NO: 337 - DNA, 78 bp, Homo sapiens
atgggtgcccgtggcgtacactgtagcgccttcctgcactaccacaggtgtgttggtcatgcagcgaatcactttggg

SEQ ID NO: 338 - DNA, 115 bp, Homo sapiens
cgcgaccggatccaggtggcgagggcggtggcagcggtggcggcagcagcggggcgccctccgccccaggccgctcctccgggtccgggctgagcgtgaggccgtcgacggacac

SEQ ID NO: 339 - DNA, 88 bp, Homo sapiens
tcgggtgcctcatcgcaggtacagcgctccatgcggcccgcgctgcacgccttggccagtgcgtgcgtcaggccagccgaggagatgg

SEQ ID NO: 340 - DNA, 85 bp, Homo sapiens
tgctttccgtctgatcctccgcccgcggcttcctcctggccgaggctgccgaggtcccgggcccgccgctctctacgcggtgatg

SEQ ID NO: 341 - DNA, 149 bp, Homo sapiens
tggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgt

SEQ ID NO: 342 - DNA, 93 bp, Homo sapiens
cagacagaactgcgcgctgctggagcaggcctatgccgtggtgtctgccctgccacagcgcgctgagaacaagctgcacgtgtccctcatgga

SEQ ID NO: 343 - DNA, 392 bp, Homo sapiens
ggacccatcgcttacactgtagaaggacacttccccggcttcgaagtccaggaagatgcccatgtggctgggaggctccatcagcatgaccggggttagggcagagaaggtggataagtacttggtccccttggacagctgcaccacccagaagccgttttcggggcacttggggaccctgtctttccggctcacgttgtccctgcacacacccagggcccacaacgcgtccccggtgatgttcatgcccacctcccagtagtgcctcccagaggagaaggccgtctggcccacagcacaggggtaagccacaaatcggtccttgctgcagaacccactgccctccggcgaagagccgaggtagcgcctctggcggctctcatacaggagga

SEQ ID NO: 344 - DNA, 106 bp, Homo sapiens
tgagctcgtggaagaagcgaaggaggagaagaagaagggaggggaaggcggaggagggcaggggcgcgcagagccacggtttgctccaggcgcgtcggaaccgcag

SEQ ID NO: 345 - DNA, 154 bp, Homo sapiens
ttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcga

SEQ ID NO: 346 - DNA, 24 bp, Homo sapiens
ttgtcaggcataggatttcactat

SEQ ID NO: 347 - DNA, 163 bp, Homo sapiens
cagcaggctaaggagatacccattcaagaactgacatgattaaaaattaagatataaatgggtgactcacaatttcattagcttacaaagatggtggagttaactactacaagcacactagttatacagtattttgtgggagaagggcatacagacatggcta

SEQ ID NO: 348 - DNA, 119 bp, Homo sapiens
gcgaccgagcagaggcctttccacctggtggtgttcggcgcgtctggcttcaccggccagttcgtgaccgaggaggtggcccgggagcaggtggacccggagcggagctcccgcctgcc

SEQ ID NO: 349 - DNA, 25 bp, Homo sapiens
ttgcccaggttgtttcacattgttt

SEQ ID NO: 350 - DNA, 97 bp, Homo sapiens
acctcacgtcacactgctgctgggatctttccacacttctgacctccagccagagcctgcgaaagctgagcctgggcaacaatgacctgggcgacct

SEQ ID NO: 351 - DNA, 215 bp, Homo sapiens
gggtagtaggctgatttcatctagataattccggtcaaccaccccagccaacactgtaactcccttcttagcctgttgacttaagaataggaggagaacaaagtgtccagggggcaatcttaacttccagtttaatggaatttttgttgggtctcctggtggcagtgctcctccctctggaactaagacctctaggccagcagaagataatgttg

SEQ ID NO: 352 - DNA, 130 bp, Homo sapiens
tgtaaagctggatcccgccacggcgcacccgagtctgctcttgaccgccgacctgcgcagtgtgcaggatggagaaccatggagggatgtccccaacaaccctgagcgatttgacacatggccctgcatc

SEQ ID NO: 353 - DNA, 25 bp, Homo sapiens
ggcctcattttgctggtgttttagg

SEQ ID NO: 354 - DNA, 42 bp, Homo sapiens
cacaagaggaggacatcccatgcggctactcctgcccagcgt

SEQ ID NO: 355 - DNA, 57 bp, Homo sapiens
atgagaagcataattgccggtgatatgtccagaaccatcacagccaggcgtggggca

SEQ ID NO: 356 - DNA, 80 bp, Homo sapiens
ttctggagggaccctatctttgtgcgggcatccggacaggctgcggtgatgtgggtacagcccagttacgtggccggttc

SEQ ID NO: 357 - DNA, 118 bp, Homo sapiens
ccagggtcttcacgggttcggtgacatttcgggtgtcccagaacttcaccttacagtcgtctccgcagctggccaagtagtactgcttattgggattaaagtcaaggtcccgcaccag

SEQ ID NO: 358 - DNA, 130 bp, Homo sapiens
gaggacgcggcacccagtagcggaggggccccgaggcaggacgcggcccgcgaggtcccaggcagcgaagccgcgcgcccggagcaggagcctcccgttgcggagccggtcccggtgtgcaccatcttca

SEQ ID NO: 359 - DNA, 92 bp, Homo sapiens
gcagccgcctctactacagcttcaagaacatcaccaagcagcacccgccgccgctcgcgcagcccgcgctgtcgcccgcgtcctcgcgctcg

SEQ ID NO: 360 - DNA, 29 bp, Homo sapiens
tggccgcccgggcagtagcagagcagcct

SEQ ID NO: 361 - DNA, 133 bp, Homo sapiens
agagccatttcttcaagaccggggagaatacctgggcaagttggtgaggttctgcaaagtagagttgcggctgcccagcgtgagcatcgtgagcaatggaagcctgatccgggagaggtggttccagaattat

SEQ ID NO: 362 - DNA, 64 bp, Homo sapiens
aggaacacgccaagctccatgggatgattcggactgaaataagcggagcggaaattgccgaaga

SEQ ID NO: 363 - DNA, 24 bp, Homo sapiens
aaaatcccactggccaacggacat

SEQ ID NO: 364 - DNA, 103 bp, Homo sapiens
gacagcctcctctgctaacaccctgtggaagacaaactctgtaagtgtggacggtggaagccggcagcgatcttcgtcagatccgccagctgtccatccaccg

SEQ ID NO: 365 - DNA, 208 bp, Homo sapiens
ctgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagc

SEQ ID NO: 366 - DNA, 216 bp, Homo sapiens
cgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcaca

SEQ ID NO: 367 - DNA, 291 bp, Homo sapiens
tcttaaatttgaggagccggaatcatgccttcctcctaatctgcagggcctctttggagctgcccccgccagcagtgaagggtgcttgtcggccagggcgcctctccccgggcgcctggctggaggtggctggagctgggacgggcagggccctggctggggtggtggttggcagctcagctctcctcccttggctgcccttgctgaacccacccctgacctttgtgggcagctgcagtgtcaggcgggagctcggggctcttgctccaagactcttgagctcccaggaag

SEQ ID NO: 368 - DNA, 150 bp, Homo sapiens
gtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctga

SEQ ID NO: 369 - DNA, 228 bp, Homo sapiens
tccagctcccggactatgagctcgcccaccccgctgacgccaggctctgggccgcactccgcggcctggcggagctcgcggcggagctgacccgccgcctcctcggcgcgcgcgcggtcccggcagcccatgatcacccgcgctcccaggcgcagtagctcggcggccgtggcgcggcccaggccgctgttcgccccggtgatcagcacagtcttcccgtgcatgagg

SEQ ID NO: 370 - DNA, 187 bp, Homo sapiens
gaaaggccactgaccaagtccagaccctgaggacgacgaaggcctcggggcagaagcctgagagaatcatgccccactggcagtgggaggcggtgcaggctgggagccctgcccaggccccaggctgagctgtggggaaagctatgacccagtttgctgagagctgcaatgacgaacattggctctg

SEQ ID NO: 371 - DNA, 107 bp, Homo sapiens
gtccacggatgacacgtcctccgaggggtcctgtggagacagcttcctgcccgggccaaagagcccctcatcagggtccacctcctcgtcaaagatggtgagccggg

SEQ ID NO: 372 - DNA, 877 bp, Homo sapiens
gagagtctacctcaaagcgtgcagtcagtgcttgaaaggaaggaatgacaattccagcaggtacagagaacttaatggagggaatctcaatggtctgctcaggcacgatgatggtgggcaactcaaagtctgcgatcttgttggctactgcatttagatccaaagcagcaatgccatctgaaacactttttggaagcgtgaactgggacacagttaactgagattcaggcacggttatctcaaaaaagggaatcaaggagtcttctggttgagaatattttgttaacacatcaacttcagggaattttacctcggggagtgttggtaggttgagggcaaatgatgaagttctcagcttcttatagatttgtatttctctgaagtcaagtttgcacgatggaacctgaagatctgtaaatgggacatggaacgtaggcatgacaagaactgaatttagatcatttagtttcagcccaggaataatgaatttatcagccaaaacttttacagggatggagaatgaatagccattggggtttttggtgtacacaaaggcagttgaaacacgaagatgctgtctcctaccaatgctggtggttacatccagctttaggaaatcccataagctcttgtcatagactggtaggatgatatttttgaggaaccttaggtgtccttctaaggatcctgcaatgtcaaggtgtgccttttcttggtcattggaaagctcgacctggctctggaaagacccagaatgaatccggacttcatttttccatctgatcttctggttcttagtgttagcattcagggccacttcctggccaaggtcagggaaatcatggaaggaactgggctgacttgcatggacctgaac

SEQ ID NO: 373 - DNA, 51 bp, Homo sapiens
tttgcaactgtaatccagctccagtggggagttcaaaggcattctccatga

SEQ ID NO: 374 - DNA, 163 bp, Homo sapiens
gagctcgtcctgtcgaacctgcaggcagacgtcctggagttgctgctggagtttgtctacacgggctccctggtcatcgactcggccaacgccaagacactgctggaggcggccagcaagttccagttccacaccttctgcaaagtctgcgtgtcctttctcg

SEQ ID NO: 375 - DNA, 24 bp, Homo sapiens
atctcaaagaagtcctccgttttc

SEQ ID NO: 376 - DNA, 44 bp, Homo sapiens
ggagcaggcgaaccctttacgtccagatggcgagtccaaaggag

SEQ ID NO: 377 - DNA, 83 bp, Homo sapiens
cgcagcatgaagttattgaaggactggttgttgatgttggtgagcgtatccttcatggccagcgcgaagtcggccaggtcagc

SEQ ID NO: 378 - DNA, 81 bp, Homo sapiens
cgtactctggctcgtcatcgcctgctttggtggcattcttgtccccagcatcggaccccacgggctcaggcgtggtagcca

SEQ ID NO: 379 - DNA, 30 bp, Homo sapiens
tgtcattcatattagtcagagggcgaggag

SEQ ID NO: 380 - DNA, 960 bp, Homo sapiens
aatgagcagggctttgatcacccccagcagagcttggcgcttctctgctgggggtccctctgacagcgaaggtctcagcaacttcagcatggccatggctagtaccagcccattcacgcctatgatggccagcactggccccacgaaggtgtataacgcccctcccttcccatccaaccagcattccccctccctcaggtattgcccttgaggtaggtagagccccagggtgacacctgccaaccccagtgggcacaggtagcccaggagcaccatgagggggagaactcggtgctttgccagctggtgaaagacaaagagcagctggtgggccaacaccagggcctgcgccagcatccagaaaaaggtggccaggtagaggaaatgacagaggaaggcggcagcaaggcagagcgggcttcggggccctggagagaggaatggggcgcccaggaagcaagtgtctgcggccagcaagcagaacaccatgttgagcagggcggcgtggcggaaataggagatcttgttccgcaccacgactctccacaccagccagtacacacccaggcacacaagcagcgccagtatggaagctcccaagcccacttgagtcagcagcgccagagcgggttcttccggaacagtgtgtggggacatgaggacggagaaggcagtgaggtgctggcagaggcactgagcagtggggctggcactggccacctgtgcctggcacccttctttggaccaaccccccctgccctggaagagactgtgatcccagaagacacagtgaggggaaccatctgtgttcccaaagtccatgatgacctctccctggctgaaggcccggtcacctgccatgatggaaatgacaaggaccaggccaggagtggcatagagggaatcccccagcccttgtccatagtttgagggcagaaggtggtccagttttcgcagcac

SEQ ID NO: 381 - DNA, 105 bp, Homo sapiens
ggaccgggccgcttaggccacgcccggggaagagggcctgacgcgctgcggggcggggccgcggggccgggtcgcgcgagcagcggagcaccaagggaacggaaa

SEQ ID NO: 382 - DNA, 106 bp, Homo sapiens
gccctcaccgatccctcctacaaggcacagatcttagtgctcacctatcctctgatcggcaactatggcatccccccagatgaaatggatgagttcggtctctgca

SEQ ID NO: 383 - DNA, 213 bp, Homo sapiens
gtgccgcagcatgtgacgtttgaggttcatgctctggttgcagctgtagttgcaaaggctacaccgaaaaggtttgtcaccagagtggatgcgaccatgacgcttgaggttggccagattgccacaggcataagggcagagggggcacttgtagggcttctctcctgtatggacgcgctggtgccgtttcaggttatccagatgagcagaggc

SEQ ID NO: 384 - DNA, 96 bp, Homo sapiens
gagccggttgacttctctgctagaagagaccttgaacaagttcaattttgccaggaacagtaccctcaactcagccgctgtcaccgtctcctctta

SEQ ID NO: 385 - DNA, 90 bp, Homo sapiens
tctgcaggggaggctgctctatctggttactgctgtgtggctgcactcactctacgtggagttgggccctgcaggaaggacggacttcag

SEQ ID NO: 386 - DNA, 188 bp, Homo sapiens
ggcaataaggttgcgaagacgtcggttgtgctgaatcaactgaatcgtatggatggtgagactacatggctctgaggggatgtccagcatagtggggggcttcggcttgttggctgagggttggtgcaggggtgggtcatggacttccaccagacggaactcccgtgggagcaaatcgaaggaacttc

SEQ ID NO: 387 - DNA, 41 bp, Homo sapiens
cggcggagatgagaacatcggcaccgttaccaccctggcga

SEQ ID NO: 388 - DNA, 47 bp, Homo sapiens
gaaaaacagagtgggtactctcttctgggaagctggcaacaaatgga

SEQ ID NO: 389 - DNA, 82 bp, Homo sapiens
gtgcagggcgacccgaaacgtggcagggaaggaccgagggcagccaagctggacgcccgctccagcgggagaagcgcggtgg

SEQ ID NO: 390 - DNA, 24 bp, Homo sapiens
caaacgggtatatgtgtctttacc

SEQ ID NO: 391 - DNA, 428 bp, Homo sapiens
ggaggtgcacagcacaccttcctccactgggagaaagggggcccaattcccactcccccaaacacacacaagtacacactgactaaggcacagctagggcgggggcgggcagaaggccccttgggaggacgtggcgccacagctgcaatgggtgtgggggtgtggagctcatcaccgctggaggtgcttgggggcaggagaagaaaagcctcagggctccccaggaaataggagaagatggtcgggaaataggcagataagaaaaccaacaggaaacctagaaaagaattgagaggaaagaaacaaaagagagagtggaaaaagagaaacgggtgaaaacaggttgtgggcaacagaacaaaacaagaaggaaacagcagaggaaagggaagaacatacatcagagaactgggaaagtgcgatgaatt

SEQ ID NO: 392 - DNA, 124 bp, Homo sapiens
attaagtcacacgcctggaaaaggctgggaacagcgagagacaatgtcagtgtccactgggtctgggcttctccctcccaggacccgccaccccgtggaacaggaacatagcaccgagcaggga

SEQ ID NO: 393 - DNA, 49 bp, Homo sapiens
gttttgcgaccacaagcttcatgatgtcttaattgccccaggaacagca

SEQ ID NO: 394 - DNA, 166 bp, Homo sapiens
aatgggcattctccaacagtggtggtccatctctgtgcatggatgggtgtgtgtgctcccttttgtaagtttttggagggagtttagggatatgttgagaagtgctttgtcgtggaggaacaggcggcccagcaatggaatgaaggtccacttcttgtgtcaatgg

SEQ ID NO: 395 - DNA, 335 bp, Homo sapiens
gctcgagtatctccggcgctgctagtagcgcgccctccgcccggcggtacctgcgggtggccggggagtcctcgccggcgccagcgctgagccccaccggctgggaacgcggctgtgtccgcgccgccgaccctcgcgcccgagggctgcgcacaccgaggccgcggtgccctctcccaagccgcggggccgaccccctgagggctgcgggcgccgaatggagccgccggggcggaatagctccccgtctccggcgctccctgcggccgcgaatccggcggccgccccgccgccgtccagaggcgagaggcaaagtgagcgggttcggaggcggc

SEQ ID NO: 396 - DNA, 68 bp, Homo sapiens
ttcaggtagcggttgagtgcgatggctgtgaggaagacaacgctggccgtgcggttggtggacagcat

SEQ ID NO: 397 - DNA, 27 bp, Homo sapiens
cgcccccggtgccgtacagcagagcgg

SEQ ID NO: 398 - DNA, 86 bp, Homo sapiens
attggttaccaccctgaggagctgcttggccgctcagcctatgaattctaccatgcgctagactccgagaacatgaccaagagtca

SEQ ID NO: 399 - DNA, 27 bp, Homo sapiens
tcgttgaggtgcgaacggcggcagcag

SEQ ID NO: 400 - DNA, 220 bp, Homo sapiens
tgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacgg

SEQ ID NO: 401 - DNA, 79 bp, Homo sapiens
tccacgcaccacaccactggaggcgctctcccttcactgcggttgggtcaatgtggacgttttccactcggccagctcc

SEQ ID NO: 402 - DNA, 84 bp, Homo sapiens
ccacgtaagtggaggagacgtgcccggtgcctcggtcgtcccattgccggtcttcgttcagggtatagaccttcactcgccgcc

SEQ ID NO: 403 - DNA, 113 bp, Homo sapiens
ctgcccggcgcctttgtccgctctgcgcccctggagtttctgtgcctccacgggcgggagcggggcgcgaaggtctgggggtgccccgaggacgcgccgcgtagtgagcctcc

SEQ ID NO: 404 - DNA, 24 bp, Homo sapiens
ttcaggtccttttgttcccatgta

SEQ ID NO: 405 - DNA, 50 bp, Homo sapiens
tgatgtcttacctcaaacaacccccatacggcatgaacgggctgggcctg

SEQ ID NO: 406 - DNA, 25 bp, Homo sapiens
gttctctgccgtcttctctcagttc

SEQ ID NO: 407 - DNA, 103 bp, Homo sapiens
ctgaactgtgctgttaacaagatgagtgtggacaacctggctactgtgattggtgtgaatctcatcaggtcgaaggtcgaagaccctgccgtgatcatgagag

SEQ ID NO: 408 - DNA, 24 bp, Homo sapiens
agggtcaagaacaaccagccagcc

SEQ ID NO: 409 - DNA, 78 bp, Homo sapiens
gcgcggcgcgaccggacgctgcgggcggggaagaggatggagactgtggcgtccgctgcaacggttggggctgcgcgt

SEQ ID NO: 410 - DNA, 34 bp, Homo sapiens
gcaaacacgtttccccgccagtcaggggcagcct

SEQ ID NO: 411 - DNA, 113 bp, Homo sapiens
cccagccgactcttctgcataggcccaaaggtgctcccggcccactgcacggagcccacctcatggggccggtgcttctcctgctccaggaggatgaggttctccactccccc

SEQ ID NO: 412 - DNA, 99 bp, Homo sapiens
atgcacaagacacaggaagataggaaatgcagaaggaggaggaggtgccggagaggtgaggacaggggctggatggacgctgggtggaaggcagggctc

SEQ ID NO: 413 - DNA, 118 bp, Homo sapiens
ctcctcagcctccgaggcctttgccacctccaacattctgcggctgctggagcagggccggctgctctctgtgcccagggcccctagcctcctggcgctgacccctagcctgccaggc

SEQ ID NO: 414 - DNA, 105 bp, Homo sapiens
ccagcaaggagtccgaccagacggcaatcgaccagacggcgatcgggagctactaccagctgttcgcagcggctgtgggcaacgtggaatggctgcgattctgtc

SEQ ID NO: 415 - DNA, 73 bp, Homo sapiens
gcaggtctggcgtcgacggaccctggagcggtgtctgacggaagtcggcaaagccacgggtcggcccgagtgc

SEQ ID NO: 416 - DNA, 138 bp, Homo sapiens
ctgagtcgggtccttggcttctctcaagccaaaccagctactcttggccttttcctccccactggatgagtgatgtggggaggcccccaggatgggaccccccttttcccccagagagcttcggcgacccaactcgct

SEQ ID NO: 417 - DNA, 82 bp, Homo sapiens
aaacagtggccgaaggcttgttatgtgctgtgcctggacttggcatgaaggcaccagatgtcagaagcgaggctgctgccca

SEQ ID NO: 418 - DNA, 194 bp, Homo sapiens
tctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcgg

SEQ ID NO: 419 - DNA, 562 bp, Homo sapiens
gtggactgctcgttgtactaggaattctggaggcacccgggctcgggcctcatcccccagtatctgctccctcccaatccagccatcagcatttagcagccccagccagtggccaagggcttcccgggtgagggagggatcccaccgctgaaccaccagctggtgaaagccttcatcccaaaggaagcctcgtgggaagaatgaccgggagggcactgctgtaaaaagaggtacgggtggaaagagggctgggtccaccttctgctcagacccttccaccccgatgtctggcaataccagcccttgtccgtagaagtagccaattccaccaaggaggccgctgagggcagcctgacccaaaacctgctcgccagagctcaggcccttctccttcagctggaaggtcttctcaaagcgctctctaaagccttcagcatggctctccagggcctgggtcagtagactgcctgccagtcttggcagggcttgatttcctcctgcctgggcactgcctgattcaaacacaaactctatggaaatgggaattttcagggtcacctgc

SEQ ID NO: 420 - DNA, 64 bp, Homo sapiens
ccacccatccagcctgttgtgagttgggtgagggctgcccccagtctccgtcctgcggctctgg

SEQ ID NO: 421 - DNA, 34 bp, Homo sapiens
cagagagcgggctcactcatgctttgcgggcggc

SEQ ID NO: 422 - DNA, 48 bp, Homo sapiens
cgacagcgcgccactccgcagcgtaacctcgcagatcccctgcgtgtg

SEQ ID NO: 423 - DNA, 35 bp, Homo sapiens
agagccacctgcaagatggacacgagccacaagct

SEQ ID NO: 424 - DNA, 104 bp, Homo sapiens
tttatactatggtggggaagctttctctgtagagcagccacagtcttttacttgtccctattgtggaaaaatgggctatacggagacatctcttcaagaacatg

SEQ ID NO: 425 - DNA, 158 bp, Homo sapiens
ggatagcgcttccgccctctaatgctctcgcgagatccgcgcgcggggcccctctccagtcccgcccctgctgcgcgcgtctctcagtctcccgctgccgccaagacgaagggcgggatttagggggcagctgctgatgtcggcgctcgccttcggct

SEQ ID NO: 426 - DNA, 65 bp, Homo sapiens
agccttggtactcggggaactgtgaccgctatgctgttgagagtgccctgctccacttacaaaag

SEQ ID NO: 427 - DNA, 93 bp, Homo sapiens
tgtccggccggtctaagcgggagtctcgcggttccactcgcgggaagcgagagtctgagtcgcggggcagctccggtcgcgtcaagcgggagc

SEQ ID NO: 428 - DNA, 41 bp, Homo sapiens
tgcgggcagggctgaccaactggcatgctggtaacattgag

SEQ ID NO: 429 - DNA, 24 bp, Homo sapiens
taattgtaatcttgtagacagtaa

SEQ ID NO: 430 - DNA, 25 bp, Homo sapiens
gcatatctttactctgacactgtca

SEQ ID NO: 431 - DNA, 28 bp, Homo sapiens
gtcctttgtgggtgccagcggctgtcct

SEQ ID NO: 432 - DNA, 77 bp, Homo sapiens
gggtgcggggatgcgccacgtgggcctgcagggcctcccggatgccgcgctgccagtctcgagccagctgcaccggg

SEQ ID NO: 433 - DNA, 35 bp, Homo sapiens
atgtcctggcagctaacaactaccccggccagcat

SEQ ID NO: 434 - DNA, 123 bp, Homo sapiens
gagagcacgatgttggcgaacagcgtccggcgcaggtccatgtcggacttgtgtatggcgaaggccaccacctcatggagcccctcactctcatccccgacaaggtccggctggaacagcagc

SEQ ID NO: 435 - DNA, 24 bp, Homo sapiens
tattgtgtccagaggatacaagct

SEQ ID NO: 436 - DNA, 26 bp, Homo sapiens
cagagggcacactcaaagtcagttac

SEQ ID NO: 437 - DNA, 184 bp, Homo sapiens
tcgaaacgggcatacaggcgtcggatgtctcgtttgctgatgcccaggaaatagtgctccaccttggttctgttatacacggtaatgcccggagggatagtcgggtatgacaccaggtggtcaatgccagcctcttttaagatgtatggggcatcgtcctccagggtctcgtggtgtccaatca

SEQ ID NO: 438 - DNA, 65 bp, Homo sapiens
atcgtcctgcgacctcacacagcagctcctgcctcagaccgttctgcagagcacgcccgctccca

SEQ ID NO: 439 - DNA, 76 bp, Homo sapiens
tcggctcctgcagatcggggtcgaggtcaaagacctcattatccagcagccttcgcagcgtcacgtcggccagctg

SEQ ID NO: 440 - DNA, 43 bp, Homo sapiens
taggagatgggtcctccatgccgagagtcactcctgccggctt

SEQ ID NO: 441 - DNA, 162 bp, Homo sapiens
gtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacc

SEQ ID NO: 442 - DNA, 54 bp, Homo sapiens
tctggagggcatcggaacctggaagccggaaagcccgatttgggagtgagaagc

SEQ ID NO: 443 - DNA, 78 bp, Homo sapiens
gactacttactactgatccacgtgtgagggaacggaagaagccaggccaagagggagcccgcagaaagtttacgtgga

SEQ ID NO: 444 - DNA, 128 bp, Homo sapiens
tcaaagctcaatccagacgtcagtctgtatgggaaaccttctcaccatccttggtcagaaataatcccttgcctgcaccactagtccacaacagctcagcgctgccttgtccagagattcacacatgc

SEQ ID NO: 445 - DNA, 122 bp, Homo sapiens
gagggcagcgtggccggcgactccgccttcagccgcgcgccgcgctgtgcgcaggtggagcgggctcagcactgcagctgcgaggccggattccacctgagcggcgccgccggcgacagcgt

SEQ ID NO: 446 - DNA, 138 bp, Homo sapiens
atcacgctcttccgcatggccacagcctctgcccccggccgagctgggcccaacagcctgcggtttgggatcgtgggtgggaacagccgcggccactttgtgatgcagcgttcagaccggcagactggggatctgatc

SEQ ID NO: 447 - DNA, 25 bp, Homo sapiens
ctccccaccatgaattttgttcaca

SEQ ID NO: 448 - DNA, 26 bp, Homo sapiens
tccctccccatggcaagatactacat

SEQ ID NO: 449 - DNA, 25 bp, Homo sapiens
gactctcacactgttcgctgtcttc

SEQ ID NO: 450 - DNA, 73 bp, Homo sapiens
atttctgctggtgagcatccggaggaatctcgggcattccacctccaccatccggcccggcacagaagagggc

SEQ ID NO: 451 - DNA, 235 bp, Homo sapiens
ggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgca

SEQ ID NO: 452 - DNA, 28 bp, Homo sapiens
ctctgcctgtgagtccttccatttcctc

SEQ ID NO: 453 - DNA, 36 bp, Homo sapiens
cagctaaggaaagaccggaatcgtccgagccctttg

SEQ ID NO: 454 - DNA, 72 bp, Homo sapiens
aatgtctctgagaaaggccgtgcacatacattgtggcatctaccatgccaatgcgccagtgcagagacagga

SEQ ID NO: 455 - DNA, 298 bp, Homo sapiens
aaatgcacaggatactgccagtcattaaatattgagtctagcacaatgtatgaagcataaaaattcactgccactggtttttaaacagctgtttcccccaaagaaagggcaacttctggtatgcaccagtaaaatagcaacctttttacattactttgcataaagatttacaagtgtcccaggacctgggaggccagtctataacaagacagcctttagcgacatcgctttccttctccacggtgatcagcgaacacaaatacccactgtgtgtcggcgagctggtctgctacatcag

SEQ ID NO: 456 - DNA, 101 bp, Homo sapiens
agtaatagaagtaactggaccaggaagaggaggcatctgctccaatgatgtcatagccattggtggccacgggggggtgggactggtcatgcagccgtgtg

SEQ ID NO: 457 - DNA, 26 bp, Homo sapiens
ctcttaagcagcatacggcactgctt

SEQ ID NO: 458 - DNA, 76 bp, Homo sapiens
agaattccggtggatgagactacggatccggcgaatggctgacgcatggatccaagcaatcaagtccctggcagaa

SEQ ID NO: 459 - DNA, 25 bp, Homo sapiens
cgtcgctgaactggccgctctcgct

SEQ ID NO: 460 - DNA, 31 bp, Homo sapiens
tttggggtcgtggctgcctatctggagtgct

SEQ ID NO: 461 - DNA, 137 bp, Homo sapiens
cagtcaggaaacgaagcaaggcttgggctgagtgaattttctattctacagggtatccaaagaggtcctttgttggcatttaacaggccggtggacttggtctggagcatcccggattgcttctcgcacctgtctgg

SEQ ID NO: 462 - DNA, 48 bp, Homo sapiens
gtgcccatgacagaaataccttataatgggtgatctgactggcatgga

SEQ ID NO: 463 - DNA, 119 bp, Homo sapiens
ctgtctccggtgtattccggctggcagtggcagtaaggctggtttccagcagtcacaatgcaggttcctccattttgacaaaaatcctcacagactgtcttaccacagtttggcccagt

SEQ ID NO: 464 - DNA, 39 bp, Homo sapiens
gtggtcgcccggtaaggaagcctgcgctggagactgctc

SEQ ID NO: 465 - DNA, 37 bp, Homo sapiens
ttggagcctggaatcgagcggcgtcatttacaaatgt

SEQ ID NO: 466 - DNA, 257 bp, Homo sapiens
gagtcagagtacccctgaggggtaatgctctgcaagtaagcccggttcatcagcagctcggtgggttccaagtgccctttctcgcgcgcctcgcgctccgccgcttcccgctcctccgcctcccgcttgcagtaggaatacctgtgattcatgtgctgcgagtacgagcccgagtgtgagaagcgcttgccacatttatcacactgatagggcttctcgcccgagtgaagccttgagtgctcgataaggtggtgctt

SEQ ID NO: 467 - DNA, 118 bp, Homo sapiens
ctggcgtgccaaggcgagacagctcctcaggggcttctgggtaaataatggctgtgtcactgcgctgaaggtactcctcgatgctgactgcatgaccatcgcgttcctccagttttct

SEQ ID NO: 468 - DNA, 1052 bp, Homo sapiens
cccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttg

SEQ ID NO: 469 - DNA, 75 bp, Homo sapiens
ggctgccttgataggaatggcatctacccgcatgtcataacctttcctcttggcttcttctaggccaagcttata

SEQ ID NO: 470 - DNA, 78 bp, Homo sapiens
cgtaacctttcagtgacggccccactaacaccaccggacgcattgacggtacaacatcgtaaggaggaatgtgctccg

SEQ ID NO: 471 - DNA, 115 bp, Homo sapiens
gggtctatatgcatccggattcccccaacactggggctcactggatgcgccaagaaatctcttttggaaaattaaaacttacgaacaacaaaggagcttcaaataacaatgggca

SEQ ID NO: 472 - DNA, 30 bp, Homo sapiens
tgccgcacaccaacgggctgctgtcgccgc

SEQ ID NO: 473 - DNA, 30 bp, Homo sapiens
tgggcggccagcggcgaatcccgggcagcc

SEQ ID NO: 474 - DNA, 68 bp, Homo sapiens
agtggtgactagtttgtagtaggctcctttttgggccatcagttcttcatgggtccccttttcaatca

SEQ ID NO: 475 - DNA, 88 bp, Homo sapiens
catcagaggcatcaaaacaatctgtttcttgatcacaataccaatgttgaggaatacagcgcccagatgcgcattggaactcactgct

SEQ ID NO: 476 - DNA, 160 bp, Homo sapiens
agaacctcccagggcgaaggtcggggccgagaagcttgtgagtaccggggcagtgagggagggatccctaagtgcagggcgcacacacggggcggagacctggaggcggcagcaccgcgcccccagggctctgcccagctagccactcgcagcacagaga

SEQ ID NO: 477 - DNA, 136 bp, Homo sapiens
ctgtagagtccaaagaagccctcataacgcaagactttcttaaaacagtcaaagctgtttttgtacattagctccccaacaacagagccagagccacgctggttttgcattcgggtcttcaccagatctataggat

SEQ ID NO: 478 - DNA, 119 bp, Homo sapiens
gaccgggaggtcaataactgcagcgtccgagctgagcccaggggagcgggcgaggagaaagaagcctcagagcgcccgggaagcctcgcgcgcctgggaggcttccatctcccgggacc

SEQ ID NO: 479 - DNA, 112 bp, Homo sapiens
tcttctcgtgggagctcccaaagcaaacaccacccagcctgggattgtggaaggagggcaggtcctcaaatgtgactggtcttctacccgccggtgccagccaattgaattt

SEQ ID NO: 480 - DNA, 36 bp, Homo sapiens
ctactcgccctcctaatggtcaaggacctcaaggcc

SEQ ID NO: 481 - DNA, 25 bp, Homo sapiens
aaaggtccagctgggatacctggat

SEQ ID NO: 482 - DNA, 24 bp, Homo sapiens
cttccctggtgctcgtggtcttcc

SEQ ID NO: 483 - DNA, 25 bp, Homo sapiens
gctgtccttgtaaaccctgtggtcc

SEQ ID NO: 484 - DNA, 154 bp, Homo sapiens
ggaggaacatttaagctgatggaagtggaagtggaagttgctgtacattggcagcaaggcctccgagttagcttttgaatgcagttaactggtttctcttaactgtggaattcattgaaaagtcagactccgagtggtcgttccaggatatctt

SEQ ID NO: 485 - DNA, 25 bp, Homo sapiens
tcattcgttctggtgccagcatttt

SEQ ID NO: 486 - DNA, 774 bp, Homo sapiens
ttttctacgtgaacgcggcgccgcacatcgggcacctgtactcggcactactggcggacgccctatgccgccaccgtcgcctccgaggtcccagcacggccgccacgcgattctccactggtaccgacgagcacgggctgaagattcagcaggcagcagctaccgcgggcctggccccgaccgagctgtgcgaccgagtctctgagcagttccagcagcttttccaggaggccggtatctcctgcacagatttcatccgcaccacggaggcccggcaccgggtggctgtgcagcacttctggggggtgcttaagtcccgcggtctgctctacaagggcgtctatgaaggttggtattgcgcttccgacgagtgcttcctgcctgaggccaaggtcacccagcagccgggcccatcgggggattcgtttcctgtatctctcgagagcgggcatccagtctcctggaccaaggaagaaaactacattttcaggctttcccagttccggaagccactccagcggtggctgcggggcaaccctcaggcgatcacccccgaaccatttcatcacgtagttcttcagtggctggacgaggagctgcccgacctgtccgtgtctcgcagaagtagccacttgcactggggcattccggtgcccggggatgattcgcagaccatctatgtatggctggatgccctggtcaactacctcactgtaattggctacccaaatgctgagttcaaatcttggtggccggccacctctcatatcatag

SEQ ID NO: 487 - DNA, 28 bp, Homo sapiens
ctggaggtggtgcaagattcataaacat

SEQ ID NO: 488 - DNA, 25 bp, Homo sapiens
aactgctcctcaggtgtagttatct

SEQ ID NO: 489 - DNA, 106 bp, Homo sapiens
cctagtgaaaaatgatggaacctgtgttattagtgactttggactgtccatgaggctgactggaaatagactggtgcgcccaggggaggaagataatgcagccata

SEQ ID NO: 490 - DNA, 24 bp, Homo sapiens
acctgttcggcccggcccggcgtg

SEQ ID NO: 491 - DNA, 94 bp, Homo sapiens
gatgtcaccggacgaacccaggaagagcttgtggccatgctcaggagcaccaagcagggggagacagcatcgctggtcattgcccgccaagaag

SEQ ID NO: 492 - DNA, 546 bp, Homo sapiens
cactgtagggagacggcacatgctcactatcataatggcttccatggggtgaggagtgtgagtgatcactgctgtattgctgtcgtgaggtgattaggtcatctgccttgctcagcagctgggcaggatgtggcctctgggaggcatggctgccgtcatgaagtccatgaaactgtcctgggaaggctctctccccaagtgcactctggctgatcagagtggcagaagtaaggccaacgttggctggggcagagaactgcccctggatctgccctgccaggggtgtaggtgggtttgacaaggtagcagaacggagcaggttctcatccagctctagactagaaaaattatcatgtactatacgcccattcaatagctcccctaggtctgtgttcacctctcggctcaaggattgtattcctgaagctccagtacctgtggagaacacccctattcctctatctgacaactcctggactggcacaccatctgactgggcaaggaccccaatggtactcaggcactcgagagaagttacagcctgca

SEQ ID NO: 493 - DNA, 27 bp, Homo sapiens
aggcagacatccagtggcccttttgtt

SEQ ID NO: 494 - DNA, 1295 bp, Homo sapiens
tgagcatgagcacccagtactcgggcttggcgcgcggctggccggtgtcgtggcccgggcaggcgcaggtgagcgccgcctcccagctctcgcggtagtgctgctcgtacaggtagcaggccaccacaatgctggcggggaccgtgtagagcagcgtgaagatgccgatgcggatcatgagcttctccagcttgtccgtcttggtgccgccctgcttgatgacgctgcggatgcggaagagcgacacgaagcccgccagcaggaagagcgtgcccaccagcaggtagagcaccagcgggcccagcacgaagccgcgcagcgagttcaggttctggttgcccacgtagcagatgccggccactgggtccccgtccacggagctcagcgccagtgccgtgatggacttgacgctggggatgagccacgcagccaggtggaagtactgcgcgtagcccgcgatggcctcgttgccccacttcatgccggcggccaggaaccaggtgagcgacaggatgacccaccagatggagctggccatgccgaagaagtagaccaggaggaagacgatggtgcacagtgcagggcccgtggtctcgtagtggatgtggttgtgctcgcggctgcaggccacgctggcatggcccacgaccagacgcaccaggaagcccagcgacacgcacaggtagcaggctgacaggaagatgatggggcgctcaggatagcggaagcgttccatgtcgatgaggaaggtggccactgtggtggacgtggagatgaagcacagcaccgaccacaggcctatccagaaggtggcgaacgtgcgctcgtcggcactgaaggacggctggtagcagggtaccgcgcagttgggcacctggcccgtccgcaccttgttgtagagcgggtgtgactccttcagaatgggcacgaagggctcgcgacacttgcacacgaacgggcccccagcggggcattcgccccccgaggccggcgcccctggcgggcctggaagggtgggcttggctgggaaaggcctggggggcgccgtggtggcctcgctgcggttgtaatccatgcagaggacctcggcgtcgcggcccagcaccgggaggcggtcgcagctcatgcgctcgggccaggcgaagccgtactggcgcatcagcggcgagcagccggccttggcgcgctcgcacaccgagcggcagggcggcagcggcttgtggtagtcgggcagacagatgggcgtgtacatagagcataggaagaagcgcaggtccggcgagcattggatctcc

SEQ ID NO: 495 - DNA, 29 bp, Homo sapiens
ccacggatcccgccgagaagagcagacag

SEQ ID NO: 496 - DNA, 104 bp, Homo sapiens
aaacagaagttcaggcccactctccctccaggaaattcattttaaaacctgctatcaaatatactagaccaactcatctctcctgtgttaagcggaaaaccaca

SEQ ID NO: 497 - DNA, 83 bp, Homo sapiens
agacatcctagtctcctgtggcgaggaccgactctggaaggtgttgggccttccaaaatgcaatgtgcttctcacgggatttg

SEQ ID NO: 498 - DNA, 87 bp, Homo sapiens
agtggaggcgtcgatgaccacaggggagctccgagcattgtcattcaaggtgtacaggtagatcttgtagtcagtgcctggttgtaa

SEQ ID NO: 499 - DNA, 336 bp, Homo sapiens
gccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcg

SEQ ID NO: 500 - DNA, 85 bp, Homo sapiens
aggacctgtgccagcagttccaactgtcggagaggcatgctgtggccgtgctgtccatcaccgctgccaatatgggcctcacctt

SEQ ID NO: 501 - DNA, 26 bp, Homo sapiens
tcagacttgggctccggaaggctgag

SEQ ID NO: 502 - DNA, 32 bp, Homo sapiens
ggcggctcggcaggcgggttcaggcttcgggg

SEQ ID NO: 503 - DNA, 365 bp, Homo sapiens
tcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagcc

SEQ ID NO: 504 - DNA, 116 bp, Homo sapiens
tgactcctaccagagcatccgtccagctcagccatccagcctgtctctaccgggccccacttctctggatcagagaccctgcctctgtttgaccccgcactgactgaataaagctc

SEQ ID NO: 505 - DNA, 93 bp, Homo sapiens
ttggcaaatcagctaactgaagacagcagccagctcaggccatccctcatctctggcctgcagcatcccatcctgtgcctgcaccttctcaag

SEQ ID NO: 506 - DNA, 45 bp, Homo sapiens
gcagcagcctgtctattgggacagcttggtcagcaaggggtgacc

SEQ ID NO: 507 - DNA, 544 bp, Homo sapiens
ccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatg

SEQ ID NO: 508 - DNA, 24 bp, Homo sapiens
ctgcgcagtgcgtgctccagcccg

SEQ ID NO: 509 - DNA, 151 bp, Homo sapiens
cagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaag

SEQ ID NO: 510 - DNA, 92 bp, Homo sapiens
ccccctgctaagtgcggcaggtggagtaaactctggattagaggacggttgacggaggctcccgggccctccccgggatgccgatgggatcg

SEQ ID NO: 511 - DNA, 85 bp, Homo sapiens
tgggtagcggatgaagaacccgggggctggacccggcctagctctggacccggctgccaggggctcgcagtcttcccgcgctccc

SEQ ID NO: 512 - DNA, 36 bp, Homo sapiens
gccaggcgtgacccctagcggcatgtcggagaggct

SEQ ID NO: 513 - DNA, 117 bp, Homo sapiens
tagaatataggcaccaacacattgagtgcccgttccaaacccatgagccccaggcagatgagcaccaccagctgcagagctggactccctcgaggccacaggtagccactcaggagg

SEQ ID NO: 514 - DNA, 121 bp, Homo sapiens
gcgggaggcacagcaccgacggcaggggcggcccaaggcccagcaccaagatccaggcttgggggggacccaggagggtgcgaggggtgaagcaaccaaacgcagtccatccccagaggag

SEQ ID NO: 515 - DNA, 61 bp, Homo sapiens
tttccgagctccgggcgctcgctcccgggccggagccgcagcgacgctggcgggagcctgc

SEQ ID NO: 516 - DNA, 119 bp, Homo sapiens
tgtcagacctgacccaggcagccaacaagaacaacgacgccctgcgccaggccaagcaggagatgatggaataccgacaccagatccagtcctacacctgcgagattgacgccctgaag

SEQ ID NO: 517 - DNA, 35 bp, Homo sapiens
agtcccagccagaaccgccgttcttctgacactgg

SEQ ID NO: 518 - DNA, 24 bp, Homo sapiens
ctacggccagccctgcccagcgag

SEQ ID NO: 519 - DNA, 26 bp, Homo sapiens
ggaactctgtcgccccttgttggtgt

SEQ ID NO: 520 - DNA, 259 bp, Homo sapiens
cggccctacaattgctcagagatgcccagtctcatacatttaatggcaacagagtgagagcttcccctgccccctacaacagagcacaattcacagttctagaatcccaggggctgaaagtggttaagaaagaaagatttacaaaacagaaaaactaagcagaatagaaatgtttgttttgattcctagtgtccctctggtctttcagttccatgtcgttactcaggcgcagagacaccgcgcatgaagggaccttgat

SEQ ID NO: 521 - DNA, 24 bp, Homo sapiens
ctggtggaccaggaaatcccagtc

SEQ ID NO: 522 - DNA, 25 bp, Homo sapiens
aaaaggtccacctggaactgcagga

SEQ ID NO: 523 - DNA, 163 bp, Homo sapiens
agctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataa

SEQ ID NO: 524 - DNA, 135 bp, Homo sapiens
gttgcaatagcttctacggccccattatagatggaagaatcttgggatggcgccttgtaatcccacaggatttgaacatagttcaaaacctggttaaaacctgctgtggcgaaagcccaccatagagaccagtag

SEQ ID NO: 525 - DNA, 105 bp, Homo sapiens
ttttggcagaggagacgctggcgagactgtcgatcgcgccggggggcgaggggctggggtcccgctttacatctggggtcggtgtccgcgggatgtgcgtcctgg

SEQ ID NO: 526 - DNA, 29 bp, Homo sapiens
ggtgacaagggttgctggcacaaggatct

SEQ ID NO: 527 - DNA, 79 bp, Homo sapiens
gtgccataactcatcatgcttttttgcatttctaggggaagttttcgttggagctgtttgggctcttcctcttttacca

SEQ ID NO: 528 - DNA, 67 bp, Homo sapiens
taatagcaaagccgacggccaggtggtctccagtgaaaagaaggcgaacgtgaatctgaaagacctt

SEQ ID NO: 529 - DNA, 24 bp, Homo sapiens
cctttacttccagtgacctgtggt

SEQ ID NO: 530 - DNA, 29 bp, Homo sapiens
tccaccatgttacgagcctccttggcacc

SEQ ID NO: 531 - DNA, 55 bp, Homo sapiens
ccagctccttgtgagcatccaaagcagtgcactcccgctcagacctctcttctac

SEQ ID NO: 532 - DNA, 45 bp, Homo sapiens
gaagtcgccactgaggtcccattccgcctcatgcaccctcagcct

SEQ ID NO: 533 - DNA, 66 bp, Homo sapiens
atggcatacgaggccaagctcccccggcaggcctcctcctctaccgtcaccgaagacttcagcgag

SEQ ID NO: 534 - DNA, 62 bp, Homo sapiens
atccgagaaatagctcagtctcaccgggacatggagcaggaactggcccacgccgtcaatgc

SEQ ID NO: 535 - DNA, 25 bp, Homo sapiens
gggcggacagcaggaccggctcttc

SEQ ID NO: 536 - DNA, 33 bp, Homo sapiens
aatgccttgttctcctatcagccctggaggacc

SEQ ID NO: 537 - DNA, 148 bp, Homo sapiens
tgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactga

SEQ ID NO: 538 - DNA, 125 bp, Homo sapiens
ggaacacgcccacatcgtgaggcgccaggaactccacaaacttggcatcgctgaaggcatctcttttacagtgaaatatggatgcaacctggtcagagatgtacaggatcttcccagacaccagg

SEQ ID NO: 539 - DNA, 106 bp, Homo sapiens
ttgctaaggccgcgcagccctagtgaccgaacgccctgcggcggccgcgcaggcgctgtggtgggctccggtgcactgtgggatggaaaccggagcggcgcgtcct

SEQ ID NO: 540 - DNA, 308 bp, Homo sapiens
ttgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctggga

SEQ ID NO: 541 - DNA, 80 bp, Homo sapiens
ggtgaacgggcacctagagagtacccagatccttctcgaagctggcgcggaccccaacggaagccggcaccatcgcagca

SEQ ID NO: 542 - DNA, 225 bp, Homo sapiens
gtcaactgaattcggcagctcggccgcctgttgccacaggctcctttcttccacggcgtcccttgcgggacccgccagagtgtgcttggcttccgcgtgtccgtgtgtctgcgcgtcgccggcgtctgtcccgtgttccctgtgaggctgccacgcccaggcgtgcatgtgcgtctcgagacctgtgggcctgggcggcagaaaggcttcccgtggctgttgcac

SEQ ID NO: 543 - DNA, 26 bp, Homo sapiens
tgccggttgagggggttcgtgccata

SEQ ID NO: 544 - DNA, 32 bp, Homo sapiens
cccgggcggacgcggacgtcgctgccagcttc

SEQ ID NO: 545 - DNA, 31 bp, Homo sapiens
tcccggacgcccttgacccatgccctcccag

SEQ ID NO: 546 - DNA, 81 bp, Homo sapiens
gagggatgagtgccgagctcacccgtgcagaaatggagggtcctgcaggaacctcccaggggcctatgtctgccggtgccc

SEQ ID NO: 547 - DNA, 110 bp, Homo sapiens
ggtggacgcctgcgactccagcccctgccagcatggaggccggtgtgagagcggcggcggggcctacctgtgcgtctgcccagagagcttcttcggctaccactgcgaga

SEQ ID NO: 548 - DNA, 76 bp, Homo sapiens
tcgagtctgaagaatccggcgatgaagaagggaagaaacacagcagtggcatcgtggccgacctcagtgaacagag

SEQ ID NO: 549 - DNA, 133 bp, Homo sapiens
gccggcgacagtggctccgacacgggcaggcccgggcgcgggagtggggattccggtgaccccttgttgaccctgcgggaattcctctgcactgtcgtcggtgctgggcctcggggcgtcgagtgcggtcgag

SEQ ID NO: 550 - DNA, 28 bp, Homo sapiens
aattaggctgagtgcagtggctaacacc

SEQ ID NO: 551 - DNA, 63 bp, Homo sapiens
gactaaatttgctctaaagtaagtttgtaacaatttacatttccaaagtgtactcttctctcc

SEQ ID NO: 552 - DNA, 51 bp, Homo sapiens
ggggatcctcatggtcttcggcctggcacccgcccaggggctgagacagtg

SEQ ID NO: 553 - DNA, 72 bp, Homo sapiens
cgtctgggttctgctacctgagcacagcctggtcccgggatgcctggacggcggtggtgtccagtacctgct

SEQ ID NO: 554 - DNA, 402 bp, Homo sapiens
tggctcctgttctacgccttgtcagggaagatgtgggttcgccccaggtgctccagaaaggtcgtgttctctatggaatgaagacgggtgggcataagcgtgggtccggggccaccctctgtcgtccgccggcgtgtttctcatccagccacgtctcggaaggtctgtgactgctgaaaacattctgtgcatgaacgttggggaaggaaacccacccagaggaggggcaggcgccaccccaggcgtcagagcaccaagccgcagagaacggaggcagcaggtgcccgggacacaccggggagaccgcaggagcagcccgtgtcttctgtggctcagtcccgcgagaaactggaggccagcgcttcacagctcccatttgcagagaccagctcccgtgaatga

SEQ ID NO: 555 - DNA, 74 bp, Homo sapiens
ttctgaaccccgtcaatgctggtcagcccctacatgctagcagccatcaactggtagataacccaggctgcaat

SEQ ID NO: 556 - DNA, 166 bp, Homo sapiens
agtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctc

SEQ ID NO: 557 - DNA, 34 bp, Homo sapiens
cctaagtgcatcagtggcgctggggatgctatac

SEQ ID NO: 558 - DNA, 66 bp, Homo sapiens
atgaggtagaggtggcccccactctcatagatgtcatccagggctacaatgttggggtgcttgatc

SEQ ID NO: 559 - DNA, 96 bp, Homo sapiens
agaacctctggcaagccgcccgactgcaactgctgaccctgcagagctggctgctggacgcaccgtgctcgctgcccgcagaagcggcactgtgct

SEQ ID NO: 560 - DNA, 33 bp, Homo sapiens
tatttgatagtcatcctgttctgcatgtatgtt

SEQ ID NO: 561 - DNA, 170 bp, Homo sapiens
tacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcat

SEQ ID NO: 562 - DNA, 30 bp, Homo sapiens
cttggggaccgaaggactgtcattgacaaa

SEQ ID NO: 563 - DNA, 186 bp, Homo sapiens
cgccgggcgggtggtagaaggacagccccagggagatgatggcggcaatctccaggatgatgagcgtcacgtcctgcagcgcctcccacacgagctgcaggaaggtttttggcttctttggaggtataaagttttgcccaaaaatttgctttctcttttccaggtctggagcggtgcccggcaaac

SEQ ID NO: 564 - DNA, 67 bp, Homo sapiens
tggcctttattgcgtaccccaaggcggtcaccatgatgcctctctccccgctgtgggccaccttgtt

SEQ ID NO: 565 - DNA, 24 bp, Homo sapiens
tacaaactgtgggtggacacctgc

SEQ ID NO: 566 - DNA, 44 bp, Homo sapiens
ggctccgtcgatgttttccggttgctctgggttgctggtcctca

SEQ ID NO: 567 - DNA, 25 bp, Homo sapiens
gccacaaacagccgcagcctggctg

SEQ ID NO: 568 - DNA, 53 bp, Homo sapiens
caacagcccagataaggaatgaaaaccaacagtggggaccgatggcccaagct

SEQ ID NO: 569 - DNA, 26 bp, Homo sapiens
gctgtggttcctgatgcctcgtgaac

SEQ ID NO: 570 - DNA, 27 bp, Homo sapiens
ggccaaggacgaggctgctctgtccca

SEQ ID NO: 571 - DNA, 24 bp, Homo sapiens
caggagaccctgaacaggtttcag

SEQ ID NO: 572 - DNA, 64 bp, Homo sapiens
gacgccagcgccagaagctcggatcgcggctgcaccgggagagcgccgatctgggtgcgaggca

SEQ ID NO: 573 - DNA, 27 bp, Homo sapiens
ccctttggtcctgtcttgccaggaagc

SEQ ID NO: 574 - DNA, 30 bp, Homo sapiens
agagaccttatttatattcaggggagcacc

SEQ ID NO: 575 - DNA, 63 bp, Homo sapiens
gtgccctggagccggttgggttgagcgcccctgcccggggaaggtagcctgcgggctcttgcc

SEQ ID NO: 576 - DNA, 29 bp, Homo sapiens
tcctagcccgaccggttcgtggcagagaa

SEQ ID NO: 577 - DNA, 62 bp, Homo sapiens
cagaagccaggctacgtagggccgcccccaaggccgccgagtttcgattccttagtgtttgg

SEQ ID NO: 578 - DNA, 95 bp, Homo sapiens
ataactcgtgctcacaggaagccacgcacccttgaaaggcaccgggtccttcttagcatcgtgcttcctgagcaagcctggcattgcctcacaga

SEQ ID NO: 579 - DNA, 27 bp, Homo sapiens
ggcctccgcgtccagggcgaaggagcc

SEQ ID NO: 580 - DNA, 95 bp, Homo sapiens
tatctgccttaagtcgagagccgaccgtggacatatctccagatactgttgggaccctcagtcttattatgctggcacaggctcaagaagtattt

SEQ ID NO: 581 - DNA, 36 bp, Homo sapiens
cctggactgcttcgggctgaacttattcttgatgaa

SEQ ID NO: 582 - DNA, 48 bp, Homo sapiens
gcaccagcgccacgatcaacgggggcctgcgccgggaacaactgatgc

SEQ ID NO: 583 - DNA, 61 bp, Homo sapiens
tggtgatgacagcagtctggcggctggccacgtcccggctcacgccatggatctccactgt

SEQ ID NO: 584 - DNA, 474 bp, Homo sapiens
ggtgtctcccacatgtctactatggcaaaaaacattaccatccccacccataccacagcatcccctagagagagtgaggtgcagggacccgagggccaggttagcacagcgctggccccagcatggagggaagccctgtgggccacggtaggctagaagggaattcgagctgggcatgaaaaggatgctccggggccattgttagtgggtttggggctgagatgagtgatcctgcctctggtcccagcatccagctgcctcgttgtctatcctgggagggtgtggtgcttcggacacgttgaggggctttgtcagcatcaggaaggcctttgcttcttgcacccaggcccagctgagacaggcccctgagtcctggctcatgttctggcagcaacttcacttttcctaaggaggggaggaggcagcagggaagcaaccctgggttttcagaaggtccttctgatggctaggcta

SEQ ID NO: 585 - DNA, 65 bp, Homo sapiens
tctttggtcagtagctttgctgcttccctgttccttggctcttactcccctattgactacagtga

SEQ ID NO: 586 - DNA, 25 bp, Homo sapiens
ctcgccctcctctggggatcgctgt

SEQ ID NO: 587 - DNA, 99 bp, Homo sapiens
tgagccgcgggcttgcttctctgccatgcgcttctcgatggctgccagggactcccgtgtgaacctgcggaagctgctggtgccccgaggtaataggaa

SEQ ID NO: 588 - DNA, 52 bp, Homo sapiens
agcgtttccaccctcacgcttttactgcagccggtcttctcgactggaatgc

SEQ ID NO: 589 - DNA, 85 bp, Homo sapiens
ggtgtttgtggtctgtagcagctgtggtctcagggttcgtcgttcctctggaggttcttgttcaaattggttctgttctgctggc

SEQ ID NO: 590 - DNA, 101 bp, Homo sapiens
ggcccagagctctgaccaaggccccatagctgcctccccatcctctgcactctcccccaaccctgaggccatgtgctctgactcggagacctcctccgcag

SEQ ID NO: 591 - DNA, 24 bp, Homo sapiens
gatattccagctggagcaaggaga

SEQ ID NO: 592 - DNA, 29 bp, Homo sapiens
atgggccagcctcgaccctgcgcagaggg

SEQ ID NO: 593 - DNA, 110 bp, Homo sapiens
ggtactcatactcctcggcactgcgacggccaaaatccatccagcccatgtagtcccggtcacttatcctgtggctggggtccaggttctgcaggttcttaacgatggac

SEQ ID NO: 594 - DNA, 102 bp, Homo sapiens
gcagggcgtcctgggctggaaccccaaataccggcacccgtcgggaggcagcaacggcgccacgtgcagcacgcaggtttccatgctgacccgcgtcagccc

SEQ ID NO: 595 - DNA, 29 bp, Homo sapiens
gcttccaagccgaagtctccctggtctga

SEQ ID NO: 596 - DNA, 25 bp, Homo sapiens
tttgccacctgagacctatgaggag

SEQ ID NO: 597 - DNA, 109 bp, Homo sapiens
gtgtccggcttcggtgccgagtgccaccgcgagtgggccgagacgcggagggaggcgcggccggagctcgggtcgccgacgctggccaggaccgcgcttcttcccggcg

SEQ ID NO: 598 - DNA, 84 bp, Homo sapiens
agggccacgcacttttctcatattcctttgccattggaagcattttgtggcctcgggttgggatacggcgcaccactgaacact

SEQ ID NO: 599 - DNA, 42 bp, Homo sapiens
aggcatttctacccggctgtggtaagcggaggttctcctctt

SEQ ID NO: 600 - DNA, 234 bp, Homo sapiens
ctgagggtttattggtcagggcccaggcagatgtcatgtgcccctgttgtccccacgcaggcccacagacatcacaggagaatgatttacaagccacttggggcctgctggcagtgagggtttacccaccccccgccccagcttgctccagtgccgccgtttacgtcatgggtacgtggcctgcagttcacggatctccaggcccatcctgttgactgcatacccagtgaggct

SEQ ID NO: 601 - DNA, 96 bp, Homo sapiens
catacacactgtacgccgcggacagtttgtagcggcactacggcctctgggtgccacattccctggacctattttccacctggcattggggtccga

SEQ ID NO: 602 - DNA, 24 bp, Homo sapiens
tacactgacagactgttggtttga

SEQ ID NO: 603 - DNA, 25 bp, Homo sapiens
tagatagcatccaggcgcccatccc

SEQ ID NO: 604 - DNA, 24 bp, Homo sapiens
acacagccccacggccaaacccca

SEQ ID NO: 605 - DNA, 24 bp, Homo sapiens
aggaagaagtcagacaccagcccc

SEQ ID NO: 606 - DNA, 158 bp, Homo sapiens
gatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatca

SEQ ID NO: 607 - DNA, 54 bp, Homo sapiens
ggattcttggcgtctgtaccacgtccagattctggccacggacgcatatctcac

SEQ ID NO: 608 - DNA, 33 bp, Homo sapiens
agattggggagaactgtgaacacaaccagccca

SEQ ID NO: 609 - DNA, 78 bp, Homo sapiens
ctgacatggggtcgttgtagccagggcgaaacctcagcgccgagcccagctgctccaccggctctacactggcaggca

SEQ ID NO: 610 - DNA, 33 bp, Homo sapiens
ctcccttctcgcctcgaggaccggcaggccctg

SEQ ID NO: 611 - DNA, 30 bp, Homo sapiens
cttggactccggtagctcctctgggcccag

SEQ ID NO: 612 - DNA, 29 bp, Homo sapiens
tccaggacgtccagcaacccctggcagcc

SEQ ID NO: 613 - DNA, 91 bp, Homo sapiens
gccagtctgtaagctgtggctccagtgacccctacccaggtgatccgtagaacgtcgctggaagcattgaggatctgcagcctcgacacac

SEQ ID NO: 614 - DNA, 29 bp, Homo sapiens
tggaggacaaaaagcaggcggcaagtatt

SEQ ID NO: 615 - DNA, 56 bp, Homo sapiens
caaacctgtagcacctgaccgacgaatcagtgggcatgtgggcatcatcttcagca

SEQ ID NO: 616 - DNA, 43 bp, Homo sapiens
cagaagctgcaggcggacgaacatctgaccaaagaggtgtggt

SEQ ID NO: 617 - DNA, 85 bp, Homo sapiens
gagacgccgggtatccctgagtcgggaggccaagccatataacaggatcccggtagctttgtcaatggtggaacccagggtctgc

SEQ ID NO: 618 - DNA, 132 bp, Homo sapiens
actaactgcaagaactgggctgttactaaaacaggtgccaagaaccatggttccagcgtcccaggccataagattcccagtgacagggacctggtttcccaaggagcctcacagctcacatcattggagata

SEQ ID NO: 619 - DNA, 85 bp, Homo sapiens
gaggttgcaatgagtggaggttgcaatgagctgagattgcaccactgcactccagcctggccaacaagagcgaaactccatttaa

SEQ ID NO: 620 - DNA, 47 bp, Homo sapiens
gggccactgcacaccagcctgggggacagagtaagactccatctcac

SEQ ID NO: 621 - DNA, 72 bp, Homo sapiens
gcgagcagtgctggcgtgtgtgcaggtgcgagtcagtgtgactgtcccggtactgcactggcagactccaac

SEQ ID NO: 622 - DNA, 75 bp, Homo sapiens
tatggcctacttcccagccatcagcctctctttcaaggagtccgtggccttcaactttggcagccgtcctctgcg

SEQ ID NO: 623 - DNA, 193 bp, Homo sapiens
ataaatacatgttgcaggactgccctcactggctcactctgtggagtgagggacctaatgggccccatttacctattgcctctgaaagttaaagggcaggaacaaggtggagggccactgccctctggcctggcatggcccagaggcagcttggggttagctcaaggcagctaagcaggtccagcccaagaac

SEQ ID NO: 624 - DNA, 113 bp, Homo sapiens
cagtgaccgatccgaagatggctaccattcagatggtgactatggtgagcacgactataggcatgacatcagtgacgagagggagagcaagaccatcatgctgcgcggccttc

SEQ ID NO: 625 - DNA, 34 bp, Homo sapiens
atccagcacccgtcaagaccatgaccatctcttc

SEQ ID NO: 626 - DNA, 141 bp, Homo sapiens
cacctacgaggacgccggcaactacatcaaggtgcagttcctcgagctcaacatgcggcgcgacgtgaaggagatctattcccacatgacgtgcgccaccgacacgcagaacgtcaaatttgtcttcgacgctgtcaccga

SEQ ID NO: 627 - DNA, 130 bp, Homo sapiens
atcatccacgaggatggctactccgaggaggaatgccggcagtaccgggcggttgtctacagcaacaccatccagtccatcatggccattgtcaaagccatgggcaacctgcagatcgactttgccgacc

SEQ ID NO: 628 - DNA, 54 bp, Homo sapiens
ccaccgacaccaagaacgtgcagttcgtgtttgacgccgtcaccgatgtcatca

SEQ ID NO: 629 - DNA, 29 bp, Homo sapiens
tgtggaatggcgagaggagtgcaactggg

SEQ ID NO: 630 - DNA, 28 bp, Homo sapiens
ctgaaggtgatctcggtccccaagggca

SEQ ID NO: 631 - DNA, 71 bp, Homo sapiens
attcactggcggtgctgcgggcctcactggctgcctcatcgtcactggaacccgagtcagcttgggcactg

SEQ ID NO: 632 - DNA, 30 bp, Homo sapiens
gcctcctccaggcgatgtcggacaaaggcc

SEQ ID NO: 633 - DNA, 60 bp, Homo sapiens
ccactgcagcggtgtgacgtcatagttatgctgccccacggagaaagtaaacacgcgcac

SEQ ID NO: 634 - DNA, 87 bp, Homo sapiens
agtgccttggccactatgcgggtagactacgaccaggtgaagatcaaggacctgaagacctctaacaaccggctcctcaacaagagg

SEQ ID NO: 635 - DNA, 72 bp, Homo sapiens
aacaagaaacatggcgcgagaccggcatttcctttgtgacctcagtcacccgcctcatggaacgtcttcttg

SEQ ID NO: 636 - DNA, 81 bp, Homo sapiens
agcggaagctgtgtgcctatcctcggctggagatctaccaggaagaccagatccatttcatgtgcccactggcacggcagg

SEQ ID NO: 637 - DNA, 50 bp, Homo sapiens
ggacactgagttggagctggatggccagcaagtggtggtgccccagggcc

SEQ ID NO: 638 - DNA, 25 bp, Homo sapiens
tctctgaagtactaacacaaggaca

SEQ ID NO: 639 - DNA, 26 bp, Homo sapiens
tgcaccaggagagacagcgggtgcag

SEQ ID NO: 640 - DNA, 31 bp, Homo sapiens
tttttcactgtggcccgcgtggccgcgtaca

SEQ ID NO: 641 - DNA, 130 bp, Homo sapiens
ccaccatcatggtgtatgcaaccatcacctcccagctgctgcccactccagccaagtcccactacaccttcaacctgagggacctctccaaggtcttccaaggcatgctcatggctgacccggccaaggt

SEQ ID NO: 642 - DNA, 66 bp, Homo sapiens
ggggccagagctacccccatggagcaggaggccccctagcagccagcaaatggcccaggccgaggg

SEQ ID NO: 643 - DNA, 28 bp, Homo sapiens
tgagctgcctgtcgagctcaccggctag

SEQ ID NO: 644 - DNA, 81 bp, Homo sapiens
gagtgtgtctacatccatgacccaacggggctcaatgtgctaaagaagggctgtgccagctactgcaaccaaaccatcatg

SEQ ID NO: 645 - DNA, 101 bp, Homo sapiens
ggactggtaaggattgaggccgtaggatgggctcgagtgtggcggtgtccccagggccccagtgagcaagtgggtgtgctgggaacctggccacaagtgaa

SEQ ID NO: 646 - DNA, 86 bp, Homo sapiens
gatgaagacacagtcgccaaccttcagccacatgtcattgtaatggagctgctcaaagtagtggcaacctggttcaccattggaca

SEQ ID NO: 647 - DNA, 111 bp, Homo sapiens
aatcctggaagatatgcaagaggaagactatctgaatttcatcctgttcagtggagatgtgtccacatggaaagagcacttagtccaggccacgcccgagaacctccagga

SEQ ID NO: 648 - DNA, 76 bp, Homo sapiens
aacacttatccagaaccatccgtggaccgaagaggttaggacagcattccagtttgatacaggtttgccggcagaa

SEQ ID NO: 649 - DNA, 24 bp, Homo sapiens
gccgggccgcgtggcccagcacct

SEQ ID NO: 650 - DNA, 364 bp, Homo sapiens
gtctgcacggtcttgaactggtcgtagccacggccgcagcacatgagctcgcagccatccatgccctccgacgtcttgttgcacaggcggccctgcgtgcccagcgagccggtgctctcattgcgcacgcagtagtcagggctggggtcgatgtagaccaggtcttgtgtggtgggcgagttgaagcggctgttgacctgtaccaacttgccccggctgttgagccgcatggccgccgcgctgtcgtacttctccttcagggcatcacccaccttgcggaagtctgccagctgcagccagcatgtcttcaggctacatgagccggacaccccatggcacttgcaggccacatcagccaggttgt

SEQ ID NO: 651 - DNA, 138 bp, Homo sapiens
cagttttacttcacgcagggtggaaatttaatgagtcaggcccgtggggatgtagcaggaggcctggccatggacatagacaactgttcagtgatggctgtggactgtgaagacagacgatattgttttcagatcacc

SEQ ID NO: 652 - DNA, 99 bp, Homo sapiens
ttgccgcaaaattcgcagacgaagggcttgtagcccgcgtggatgcggatatgcgtgttgagcgtggagctgcggttgaacgctttgccgcactggttg

SEQ ID NO: 653 - DNA, 26 bp, Homo sapiens
cggggagcagcgcacccaacagcccc

SEQ ID NO: 654 - DNA, 91 bp, Homo sapiens
agaggcgggactagaacgtgggtagcttgaggtccggaccaacgtgctgtcccactgcatgacacgcaacacagacgacttggggtggcag

SEQ ID NO: 655 - DNA, 70 bp, Homo sapiens
gccacgactggaccttccacggcccgggcgccaccggccaggcggccgccaactggacggcgggcttcgg

SEQ ID NO: 656 - DNA, 94 bp, Homo sapiens
gcggcggtcgcgaagggcaaccgagggggccgtgaccaccgcctccccgcgacgccccagtccagtggcctcgcgtccgcccattcagcggaga

SEQ ID NO: 657 - DNA, 119 bp, Homo sapiens
agggagtcgctcaagtaaatcttgtatctgagagagttgcacagctgcactcctacaaattttttataccatgtccttttgacatattgtttgcccttacactctgagtaagagtctga

SEQ ID NO: 658 - DNA, 59 bp, Homo sapiens
ggagcggcggcaccgtagggagaaacggctgcgcctttggcgagcgctcttcgacggct

SEQ ID NO: 659 - DNA, 24 bp, Homo sapiens
ctaacagtctagaactatctcaag

SEQ ID NO: 660 - DNA, 165 bp, Homo sapiens
gcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcct

SEQ ID NO: 661 - DNA, 97 bp, Homo sapiens
atagtaaaattatcatttcccctgaagagaatgttacattaacttgcacagcagaaaaccaactggagagaacagtaaactccttgaatgtctctgc

SEQ ID NO: 662 - DNA, 24 bp, Homo sapiens
attaaggggttcctctacagcttt

SEQ ID NO: 663 - DNA, 34 bp, Homo sapiens
agcccagcaacagcgccgctaccaggggccacat

SEQ ID NO: 664 - DNA, 29 bp, Homo sapiens
gccttgagtaccttgcctccagtccagct

SEQ ID NO: 665 - DNA, 207 bp, Homo sapiens
ctggtctctgtctgaaagcagtgctctaccaagtcctggagatgaagggaattcactctgttttgcagaaaagattctgtggattaatacagaagcaccagcaacaccagaggggtggagactcctttctctcccgattctacagtctggctctaagcccagtaaaacagctcccgagcactgcttcagctgggtccagtcttgaca

SEQ ID NO: 666 - DNA, 203 bp, Homo sapiens
gcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtg

SEQ ID NO: 667 - DNA, 24 bp, Homo sapiens
catcttgtatcacagcagcaacac

SEQ ID NO: 668 - DNA, 78 bp, Homo sapiens
atctgcacatcgtgctgccacacgaggcttcattcgttatggctggcgctggggttggagaactgcagtgtttgtgac

SEQ ID NO: 669 - DNA, 749 bp, Homo sapiens
atgaatgattttgcctggtcccagttaattttgatttttcagccctttcatcttgatctcctccatcttgatcaccttggtggtgctcatcaagtactggatcacttagttctaatgctctaggagatactacagtatgattcttctcttggacaggaaatatatccacattgtccaaagcttcaaccatctgaacagaatccatttctgaaaatataatagattcatcattggaacaagtcaactgctggtgggtatcttgattctcatttacatttgattttttaattaggtcttcttgtagacacagagaatcactaaaatggtttgatgttacttctgaaggaaggggttctttcatttgcatatcaggtaattgttcttttactagatagtcatcactgaagctatcaaatagtaaactatcactcatattcaaacttgtttcaggaactggaagacattctccttctacaccagtgggagttctcttttgaggaatcagaagtataactggtttcacagtttcttgtgtttgataaccttgaagaaaactatttaattgtgaatcagtaacagaaacttcattcttttttaaaaaaagaccattttcctccaatagtattggagaatggaaaatcgggctttctggagtcaggatatcaaccccatgtgaatcactgctttgtttcatagtacctacagtcttaaggtccaaatgatctatcttagtcgctcctagagggtgc

SEQ ID NO: 670 - DNA, 336 bp, Homo sapiens
taagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttc

SEQ ID NO: 671 - DNA, 94 bp, Homo sapiens
cccacgatgagctggttcccggaggggtccaaagccagctgggagaaatcccgggctccagggtaggtgaagttagagacccacggctgcaggt

SEQ ID NO: 672 - DNA, 50 bp, Homo sapiens
acttcagacggctcctgaagaaggaagagaagccgctcctgatcatgttt

SEQ ID NO: 673 - DNA, 81 bp, Homo sapiens
atgcggtcgggtacaccggtgctgtccatgcggctggccacgttcacggtattgccccagatgtcgtactgaggctttcgt

SEQ ID NO: 674 - DNA, 104 bp, Homo sapiens
ggcctccagctcaacgtagaactcggagaagttggcgatggaggcgaacatgaccgccacacactcacaggactgatagtagagctcatcattgcgccgctcgc

SEQ ID NO: 675 - DNA, 236 bp, Homo sapiens
ggtcgtcaccgctcagcggaggatcgtcgtcgtcgtcgctgcgccagcggctggccaggcgctgctgctgctgcggggtcaccgcccccccgggtttcttggtggagccgcgggcagagcccccgggggcatgggggtagccattcgcgcgggaatcggcctcgccccacgcagagcggtgttcggggcctccccggggcgccggcgccgcagtcttctgcgccgcgtagcccggg

SEQ ID NO: 676 - DNA, 24 bp, Homo sapiens
aagcccagggtagtctttctgcat

SEQ ID NO: 677 - DNA, 30 bp, Homo sapiens
gctgtggaccgctatcaccctctttatctt

SEQ ID NO: 678 - DNA, 29 bp, Homo sapiens
aatggccctgcggaagttctccatcagca

SEQ ID NO: 679 - DNA, 32 bp, Homo sapiens
cagagcctgggcggcacgccgagcggccgcat

SEQ ID NO: 680 - DNA, 37 bp, Homo sapiens
ggctgtcaccagagagcccgacggcttcaaggaacac

SEQ ID NO: 681 - DNA, 24 bp, Homo sapiens
cctgcaggcagtgctctctaacag

SEQ ID NO: 682 - DNA, 77 bp, Homo sapiens
gcctctgaaggcgtgatgctgggcttgttctccagccacctctttacatcaccaaaggactctagctcctgccgcag

SEQ ID NO: 683 - DNA, 24 bp, Homo sapiens
gcccgagccgtaagggaagccgtg

SEQ ID NO: 684 - DNA, 156 bp, Homo sapiens
ggcgcggcgagtgcatggggcgaggcgcggccgggagccgggagcccggaggcggcgggaggcggggggcgggcccgggccgcgatgcgcttcctgcccgcgccagccgcccccgaccccggcgcccgggcccgggtcagcctcgccgcgcagccc

SEQ ID NO: 685 - DNA, 62 bp, Homo sapiens
cttggagtagaaccagtggataaagatgtcattcgtaaacctcctcgcaactggaaagacag

SEQ ID NO: 686 - DNA, 98 bp, Homo sapiens
ctggctcctgcacgtgagagtccaatctcaagagcgggaatcggaagtctcccggtgtgacgtctctgggaagtacagttccgtgatgccggtggcgc

SEQ ID NO: 687 - DNA, 53 bp, Homo sapiens
tggtattttggcaacgcagacaaagaaaggagtggcccgtatggatttcatga

SEQ ID NO: 688 - DNA, 26 bp, Homo sapiens
cgcgatcgtgccaccgcagcgagacc

SEQ ID NO: 689 - DNA, 41 bp, Homo sapiens
ctgcagacagaaactatccaggccggagcagatgactttaa

SEQ ID NO: 690 - DNA, 95 bp, Homo sapiens
caaacagttggcagggtgtgagctggaacaaatggatgctcccattggcactggtctggacgacatccttgagacgatcagaattcagtgggaga

SEQ ID NO: 691 - DNA, 382 bp, Homo sapiens
gcggtggctaagaacatgcacattcttgaatgtcctctgcatggtgcctggccttctggatggtttcggacaaaactttatgtgctaggtgggagtgggaaaaggagtgggggaaggataaagccatctttggacacccactcccactgtggataaccacagcgtgtggccgaacaaagctgattagaacacagccctacctcgggaggctgccatctgccaggccctccttcccctcccagccttcaagaaatgttatctatgaaaggggaaaaatgccagccacatcctcattccaactctatccttaatgcagcttcacaaaattcctaaattctatcttgggtccttgaagagattggactatgacttgggtggcccc

SEQ ID NO: 692 - DNA, 58 bp, Homo sapiens
aatggacaccagaacggctactgcagagctgggctggacggccaatcctgcgtccggg

SEQ ID NO: 693 - DNA, 245 bp, Homo sapiens
cacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgttt

SEQ ID NO: 694 - DNA, 80 bp, Homo sapiens
gaggctgcggtagcggccacgagttgttgaggaagccagactgcaggtacttggggggcgccaggtagccgtagccgtcg

SEQ ID NO: 695 - DNA, 138 bp, Homo sapiens
ttctgcacgctggagccgcagacccgcgccgcccggtcatagacgtggcagcggatcacagaactgcccacatccagccccagcacgaagccggggtaccgcggctcctgcgctctctgctccgggtccgtgagcagc

SEQ ID NO: 696 - DNA, 187 bp, Homo sapiens
ccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgca

SEQ ID NO: 697 - DNA, 89 bp, Homo sapiens
tcctttggtccagtcggaggctgcggagcggcgggggttgcctgcgctgtccgcccgggcatcctcccggtgatggaagcagccgccgc

SEQ ID NO: 698 - DNA, 24 bp, Homo sapiens
tcggcagacaggaaggcactccaa

SEQ ID NO: 699 - DNA, 139 bp, Homo sapiens
cgctcgggtgagtcccgagattgcggagctggagccgaggcttggctgacaaatcccgacccgactctgtgcctggcagtctaagggcttcggctctcacatcccccgagctggcctaaggcgctagtgctgggcgaaa

SEQ ID NO: 700 - DNA, 30 bp, Homo sapiens
tgattttgtattatcacctggaccccaacc

SEQ ID NO: 701 - DNA, 248 bp, Homo sapiens
cttttcttcaggagacagtgcgtagagaatgtgaagaacgctttgaactgacagaggctttgagtcaagccagagaacagctcctggagctcagtaagcttcgtggaagtttaccattctcaccgtgttccctcagcaagggcagcctaacctcccctgctgcagcagtcagtaatcatggagagagaagccttgcaagactgaactctgaaaaaggaatccaaattcccaacctgcgcggggtgtca

SEQ ID NO: 702 - DNA, 332 bp, Homo sapiens
gatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattg

SEQ ID NO: 703 - DNA, 84 bp, Homo sapiens
cccgccggtggatgctccgcgcctgccctccgcagcctcgctcagcagtcctgcgttggggtctgcgccctaggatgcactgag

SEQ ID NO: 704 - DNA, 65 bp, Homo sapiens
ttcattggctttagtatttgctcttcaccactacaagcccactcccctttacttcatggatgaga

SEQ ID NO: 705 - DNA, 29 bp, Homo sapiens
gtttcatggggatagtcttcgctcttcat

SEQ ID NO: 706 - DNA, 39 bp, Homo sapiens
gaagttgatgggggtagttcccaataagacatcttcctg

SEQ ID NO: 707 - DNA, 57 bp, Homo sapiens
aggcacagggagaggataggacccgcgagagaaagcctgagcgcgcgctgagaccca

SEQ ID NO: 708 - DNA, 142 bp, Homo sapiens
gtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggac

SEQ ID NO: 709 - DNA, 66 bp, Homo sapiens
tccccgggagttcaactctgtctccgtataaggttcctcagacgttctcagaggacgagctagagg

SEQ ID NO: 710 - DNA, 104 bp, Homo sapiens
tcgtggcgaccacaagtcctatcacgccacaagaatctcggcttgttcacctacaaatgaaggccgacgatacttgcagaccgagtctgacatctatgggaccc

SEQ ID NO: 711 - DNA, 75 bp, Homo sapiens
tagagaaggccgaggctcgacttaaggcaaagcaggagaagcgctcagagaaggacacgctcaagaccagcaacc

SEQ ID NO: 712 - DNA, 166 bp, Homo sapiens
gacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactg

SEQ ID NO: 713 - DNA, 182 bp, Homo sapiens
tacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactga

SEQ ID NO: 714 - DNA, 84 bp, Homo sapiens
ttccagactgccaagacccggaagatgaaggcactgaaggtggcagcgaagaagccccgccagtagttccgcactgcaaagaag

SEQ ID NO: 715 - DNA, 25 bp, Homo sapiens
gcaagggtctgaggcgtccccattg

SEQ ID NO: 716 - DNA, 233 bp, Homo sapiens
accgcggagagttctgcgaggcctgccaggagggcatcgtgcactggaagcccagcgagaagctgctggaggaggaggcgaccacctacaccttctcccgggcgcccagccccaccaagtcgcaggaccagacgggctcaggctggaacttctgctctatcccctggtgcttgttttgggccacggtcctgctgctgatcatctacctgcagttctctttccgtagctccgta

SEQ ID NO: 717 - DNA, 62 bp, Homo sapiens
ctttcttcttcagcggggcataagccttctggcaggtgctgtggtcaacaatcgggatttca

SEQ ID NO: 718 - DNA, 102 bp, Homo sapiens
aaacttccggcaagtgtccacaacatgctccatctgcaggtacatagccgtggccatcacagccatgatgttgccctcccgcaaattgagccgagatgtgta

SEQ ID NO: 719 - DNA, 24 bp, Homo sapiens
tgagaggcggaggccgtgcctggc

SEQ ID NO: 720 - DNA, 25 bp, Homo sapiens
aaggcacgggttgcttgcaatgtgc

SEQ ID NO: 721 - DNA, 54 bp, Homo sapiens
aggtagagccggaggaaccgcaattgtgatgacgtcaagggctttcctcaccac

SEQ ID NO: 722 - DNA, 31 bp, Homo sapiens
aattcctcgtccccggtggctgctaccccag

SEQ ID NO: 723 - DNA, 459 bp, Homo sapiens
gatttcggtggaactgcagctccgtcagggcgcccaggctgttcaacagccccgaatccagagacacaaggcggttcgagtggagcagaagtctctcgagcttagcctgtgctccaagcaaccccttgggcaggtgggtcaggttgtttcccgataaatccaacaacttcaggttctccagattcgtgaagagactggcaggaaggaaatcgagctgattctggttcagagcgagctcctgcaggttaaccagtttctgaaacatgttttggtcaatgccccttagcgcattgtggtccaaaaacaactgctccaggagcaccatcttatccagcagcgcacctggaagatgcgtgattttgttgcgcgacagcctcagggttttcagttttatcaggtcactgaaggtgccgggggcaacggcggaaatgtggctgtcggagatcatgaggcgctgca

SEQ ID NO: 724 - DNA, 110 bp, Homo sapiens
agcgcagccgcagcgcgcccaagcttggctccatcaccgaggacctgctcggcgaacagctggagcaggagctgcaggaggaagaggaagaggagcaacccgagggctgc

SEQ ID NO: 725 - DNA, 74 bp, Homo sapiens
ggccgcgctgggacgcagacggctacggcgggcgcacggccgcgactagcgttgcgcggagctgcgaagggcgc

SEQ ID NO: 726 - DNA, 58 bp, Homo sapiens
aatggaggtttcctcctcctgcggctgagtgtggcttccccggaagacctcactgacc

SEQ ID NO: 727 - DNA, 26 bp, Homo sapiens
aatcgtaagtcccgtcgtccctgctg

SEQ ID NO: 728 - DNA, 297 bp, Homo sapiens
ccccacgctaatcacccttttctctcctcagccccaccccactaccccaccaggaaagaaaacaccgatacacccgttgctctgcttctcatcagcctgagctgagtggcgggagggatgggaggagacatgggggaatgggaacaggtcacactggaaatgggtgggccaccctcctagccgggttcctgggtcctctcctccctccccaggggctgcccctgtcccaccagagctttgggctgctgggaagaatggggaagaaagggccccagagggagcgaccttggggctgta

SEQ ID NO: 729 - DNA, 24 bp, Homo sapiens
gctgttgatgacatgaacgaccac

SEQ ID NO: 730 - DNA, 348 bp, Homo sapiens
gtccacatgacaccaggctctgaggcctctgaggccgaaaagccactgaggagcagatattggaatgtctcttcaaggatctgataactttcttgttttccaagtctaggattttgattgccccagagtcgtcagcagaagccagcaggttttccgtttgattcaatgaaagacaattgatttcttcttcattcacatgaaaatggtccaaggaatctttgagggacctgacatccagtacactaatggtttctccatgtgaggcatagagcttggtgggacaggagggagaaaataagacactggtaacatcatcagccccttggaaccgcgtgtgtcctaatggag

SEQ ID NO: 731 - DNA, 83 bp, Homo sapiens
ccttaaagcctgcgtcccagtctgtgcgaatgattcggtcatccagacgcgtcccatttatgtaccgcatggcgttttccgca

SEQ ID NO: 732 - DNA, 164 bp, Homo sapiens
aacgtctgtcagagtcgcggcctatccgacgtgcggcgcagctcacggccttcgcactgctgcaggcccagctgcggggccaggacgcggcccgccgcctgcaggacctcgcggctgggcccgtgggctccctgtgccgccgcgctgagcgatttagagacgcc

SEQ ID NO: 733 - DNA, 42 bp, Homo sapiens
gagcctgctgactgcgatgaggacgagctgggcgaaatcctg

SEQ ID NO: 734 - DNA, 78 bp, Homo sapiens
ggttggtgaagagccgctctgtcccaccccgcagaatgtccaggaagccgccatacggctggtcgtactccgccagcg

SEQ ID NO: 735 - DNA, 43 bp, Homo sapiens
cgccggccagcacgtcagaggagccgcacgtcttcctgcagac

SEQ ID NO: 736 - DNA, 107 bp, Homo sapiens
ggtctacgtcacgcgctacctggacaacgggctctgcagccccgacggcgagtggcggcgcctgggccggcccgtcttccccacggcagagcagttccggcgcatgc

SEQ ID NO: 737 - DNA, 38 bp, Homo sapiens
ctggtccggctgatgggggtttgctcagcactgtgcca

SEQ ID NO: 738 - DNA, 34 bp, Homo sapiens
cccaggggtccgagtcgaggctggcgagctggat

SEQ ID NO: 739 - DNA, 78 bp, Homo sapiens
tgctccatagaccaccgcgtacaccaccttcttggtttgctctctgtctgcgtgtgtcacctgttccacgggcacatc

SEQ ID NO: 740 - DNA, 29 bp, Homo sapiens
ccggcggtggcgcctgcggacctaactag

SEQ ID NO: 741 - DNA, 151 bp, Homo sapiens
cgtccactagggacggcgcggcgtccccctccagcgcggccaggcgggcgcggaggcgagcgatgagggcgtcgcgggcagcgagctggtcctgcaggcggcgcagccgctgtccggcctcgtggtacagggtgcagagcgcggcagctgc

SEQ ID NO: 742 - DNA, 36 bp, Homo sapiens
tccactggcatcccgatggcggtggcaaaccagtcc

SEQ ID NO: 743 - DNA, 93 bp, Homo sapiens
cctgagggcccgtgcgcgagacaccccgggcagtcccacgtcgtggcgcgtcttccggcccaggatctggaacttctgcctgttaactttcac

SEQ ID NO: 744 - DNA, 75 bp, Homo sapiens
ttctctcacctgctgaaggtgattaacatttgtgcccacgtcctggatgacgtggctcctggacccgcaataaag

SEQ ID NO: 745 - DNA, 73 bp, Homo sapiens
gggacccatggcagccgagacctcccagtcaacagaatcatcgatgtggatcttgtaactggctcggcgcccg

SEQ ID NO: 746 - DNA, 424 bp, Homo sapiens
gtcacttggacgtcagcgccagcagccggctcaccgcatggccagagcaatcctcgtcgtcagccagcacgtcacaggaggggcctagaccagcagctgcccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctcactgctcagcctgccagcagcgggggcccccgagcccagcctgtgcacctgcctgcccgggacagtcgagtaccaggtgcccacctccctgcgggcccactatgacacaccacgcagcctttg

SEQ ID NO: 747 - DNA, 185 bp, Homo sapiens
ttccgagtgcctccgcttcctcttccctgcgcccacgtgtgcctcttcctcactggcgctgtccttgcgctgcttcttcttcttgctcctcttccctgcagagccattggcctcagggacttcctccccaccagcctcaaggtcagcctcctgtccctttttgcgcttcttaggcttctgattcc

SEQ ID NO: 748 - DNA, 80 bp, Homo sapiens
tcctcacctgcgtcgtcttcctggttgtctacaaggtgtacaagtatgaccgcgcctgccccgatgggttcgtcctcaag

SEQ ID NO: 749 - DNA, 356 bp, Homo sapiens
aatgaaagagtgggtcctgtcagcactacgtaaaatatatatcttaagagcattaatttctttttaaatgaaagacagtgaagaaagtctgtgttagaaaaaggcataatagaagcttggttaaatgtaagcaggtttctatcaagaaagaataaaagtaccattactccattaaaccagtaataaaaacatactattgtgcaagttctcaaaatagttgttcataaaagtgaagcttgttagtccttttcttctttttagtgaccaaatcaacatgctgtgtatctaaccatcctggcaagacatgagtcaagggaatgagaagcatggttgctaactctatgctcaaaggaggt

SEQ ID NO: 750 - DNA, 25 bp, Homo sapiens
ccaacctgatgcacagcatctggga

SEQ ID NO: 751 - DNA, 25 bp, Homo sapiens
tgtgcacaacaaccggggagatggc

SEQ ID NO: 752 - DNA, 36 bp, Homo sapiens
ctggctgcttgtcgacacgccggatgccagatggag

SEQ ID NO: 753 - DNA, 30 bp, Homo sapiens
tcgccgtcggctctgccaatcggtgagtcc

SEQ ID NO: 754 - DNA, 35 bp, Homo sapiens
caggaggagcgatcacgtctaccagggcaactgca

SEQ ID NO: 755 - DNA, 36 bp, Homo sapiens
agtgtggggcggtgaagacgtccacttcttcaggaa

SEQ ID NO: 756 - DNA, 25 bp, Homo sapiens
ttaccacttatttcctcatatgaat

SEQ ID NO: 757 - DNA, 37 bp, Homo sapiens
gtgtatattgatctcactgatgcactgtggaagtaac

SEQ ID NO: 758 - DNA, 51 bp, Homo sapiens
ctctgtcatcaggaccctccgtccacgtcccctgtgcggccagcgtcagag

SEQ ID NO: 759 - DNA, 28 bp, Homo sapiens
tgtttgagtgcgccgtccgaactgccgt

SEQ ID NO: 760 - DNA, 398 bp, Homo sapiens
aaaggttgcttgtgacaggtccagccaagaagacagtgaaactaactcacgcatcattcattccaaggacgcagcgttagttcactaggaggggtggggccacactcttctctgtgtgtgtgtgaagttaagtaatgttcacaatatttacaataagaaaaagaccttccactgcgcatgatgtaacttacagcaaaaaaaattattcatgcttcttttcatatcacatgatggtggcaagacgagagaacatgcttgtctaacactgcttggttaagggtaaattctctgaagacaaagcatcagcaactggatggaaggtcggatggcggagttcattttctttagtgtagctagtcaatcttcaggtaaatagccgagtccttttgcatgtgcag

SEQ ID NO: 761 - DNA, 117 bp, Homo sapiens
tgggattccgagcgcagcgactccctctctcctcctcgccacggcagagatgattccttcgacagcctggattcctttggctctcgctctcggcagacgccttcaccagatgtagtc

SEQ ID NO: 762 - DNA, 24 bp, Homo sapiens
aacaggtccaaagctggtgacata

SEQ ID NO: 763 - DNA, 51 bp, Homo sapiens
ggaagcgcaggagggcgaaactgaccccggcggacagagcgatcgcgggta

SEQ ID NO: 764 - DNA, 35 bp, Homo sapiens
ggctttcgttttgacggctgcacacggcccgtgtt

SEQ ID NO: 765 - DNA, 82 bp, Homo sapiens
ttcctcactggagtacacggtggtgtctgtgtcatcggagtgatatccggactggtagccgcttgtctggtttgagccttca

SEQ ID NO: 766 - DNA, 163 bp, Homo sapiens
agtagatgagacttctccaagctgcttcacaagcaaactaaccgaaaaaccgaaaatatacaaacagcttcacacacacacacacacacacacacacacacacacacacacaaaggaagatcatcaatggctgcggtagcctagtaggaatggactatataat

SEQ ID NO: 767 - DNA, 93 bp, Homo sapiens
gcggcagtagagaaaagtaatcgaaagccaagcacggcagactatcatgggggtagccttctctttgggggctactttctgggtgccatattt

SEQ ID NO: 768 - DNA, 209 bp, Homo sapiens
cactgaaagtatgccgaggttacgtctctcctggttattcaggtttgatgttcaggctgggacttctgagagtctcatggaactttctcgtcactatcttctcgtccctgacctctctcctagccaagcaagcttcttcaccaagataggataagagagatgtggctgagagaagacggggaagagaaaagggaccctgagtcttctca

SEQ ID NO: 769 - DNA, 36 bp, Homo sapiens
tccagacccgtgtccaggaacctataaataccttga

SEQ ID NO: 770 - DNA, 127 bp, Homo sapiens
agaggctccacagtagtgacggcctttccattgcatgctggcctgccatggccatgccccctccagggagctttttccattcacaattttgttgccagttatgatactgttggctacttgtctccca

SEQ ID NO: 771 - DNA, 978 bp, Homo sapiens
gctagggcctcgaggatgtcgctatatatttttataactaaatgataaatttatattcaaattgtttgaatacgtttccaaaactttcagagtacaagtcattgttaagtttgcctttactttaaaaactaaaagaatacatttctatataaactagcagtcaggaatttgcctgttttctagcttcttcatctatctaaaatatatatttagctaccagaattatggtactcctaataaaatacttaataaatagcatataaaatcaaagtttaaaagtaaatgatggcagtttgccatactaaaaagataaagaatgtctaaaattataggaagataagatattagccctcatagaacttaaacttttagaaattctgaataaggaaatatattctacatagataaggtgtgaaacactcagctttctaaagtgaaataattaaatagtatcccacaatcaagagtaaggaaattctctaacatattccccaagaaacattaaaatatttcctatttcttataaaagtgaagataacagtgtatttccatcaacagaattcttatgaaacatcatttccacattaaatccacagccttctcagttaatatcttaaggaatatttcttggaaatataatagtcacctacaattcaagacactttgaaagattaacagccagtgattcctggctcacactatagtcaattgccaaaacttcaatagcatagcagataaaataacagcaaatagcagaggtactatgctaaacacttcattagctgagctgaaagcttaagcggcaaacataggttttcctcacactcttcaaagtgaggaatccaggaagaaagctaactactggaaaaacaaataaacaaacaacaacaaaatctttccttcttgtcttccctgggttcagagacctccagaaaacttctctgctgaagactgggaaacttttccatgcgtgctcat

SEQ ID NO: 772 - DNA, 32 bp, Homo sapiens
tgtgaaaatccttgaacccacccaaatacctg

SEQ ID NO: 773 - DNA, 102 bp, Homo sapiens
actcccttgctgatagtttctcccatacatgcattccaccatgtctttgatctgctgaggatccagtcttttcagaaactgatttttattaagggcatctgt

SEQ ID NO: 774 - DNA, 38 bp, Homo sapiens
ttcgaccaaactcatacctttctaccaaaatccttgag

SEQ ID NO: 775 - DNA, 55 bp, Homo sapiens
attccaaccgtaacttctcctccacatcaggagggatggatccatatttgcaaat

SEQ ID NO: 776 - DNA, 61 bp, Homo sapiens
ggaggatgaggaaccgcgggtccgtggccaggttggcgtcaatggtgacggacaggaacga

SEQ ID NO: 777 - DNA, 70 bp, Homo sapiens
gtccgagtccgtgttgaggtgctggaaagcgagtgcgccgagcacaaagcccgagagcaccgccgacgta

SEQ ID NO: 778 - DNA, 25 bp, Homo sapiens
tccgcaggggaaacaaaactgcaca

SEQ ID NO: 779 - DNA, 27 bp, Homo sapiens
ttgatacacaccaaccaggctgaaagt

SEQ ID NO: 780 - DNA, 25 bp, Homo sapiens
caccagcagactgtgagtctttgtg

SEQ ID NO: 781 - DNA, 30 bp, Homo sapiens
gaacccccttctctcgcaggatcaatctcc

SEQ ID NO: 782 - DNA, 25 bp, Homo sapiens
gattttaggtgtcgatgaatacggc

SEQ ID NO: 783 - DNA, 95 bp, Homo sapiens
gccaataaagtgcccccatcgtgtgcccttgctgatccactatctcgctgcgactacggcggtagaattcagtttctgttttgacacactgggcc

SEQ ID NO: 784 - DNA, 102 bp, Homo sapiens
ccgggatgatttcagactcgttcaccaaggaagacttgatgtcagctaaatcgccttcctcttcgggatgactgatctcggcgaagatcttttccttctgag

SEQ ID NO: 785 - DNA, 193 bp, Homo sapiens
agtcttgaggtgatccagggtatcaggcagcagatgaatggaaggggcccctttggcggattcgagagcggcgatcctcgcctggaggtcgttggttttcacacccaggtacaggcaagacaccacggccaccactgacaggagggccgccaggacggcacacgggggcatggtccgggcacaatgctgttcg

SEQ ID NO: 786 - DNA, 24 bp, Homo sapiens
taaaaatatccagtgagatttgct

SEQ ID NO: 787 - DNA, 28 bp, Homo sapiens
aggttccagaccagagtattattgctaa

SEQ ID NO: 788 - DNA, 365 bp, Homo sapiens
ttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacgga

SEQ ID NO: 789 - DNA, 78 bp, Homo sapiens
agtccttggctactgccccgccgagcccccgtagccgccgctgcccgctccgggtcgcgctctaggcgcggagtttcc

SEQ ID NO: 790 - DNA, 112 bp, Homo sapiens
tttggcaaatacgtgtagacctacatttattaaatcatgatggaaatattattgatgctgccagcattgctgcaatcgtggccttatgtcatttccgaagacctgatgtctc

SEQ ID NO: 791 - DNA, 540 bp, Homo sapiens
cgttgctgagctctagggccgtaagcaccgggtcctcgctggacaatgagaggtaagccgggctggccagccccttgtaggcattgatcctcgagcgtgagtggctgaaggagtcgtgcctctgcttctccatgcagtccccgcacttgcagaaatagtcgtgcggccgctcgatcctggcacccttcatcagcagcatgtgcaccacttcgtatttctggcagtgcgccgccaggatgatgggggtgatgtccggcgagaagcgcgtgccgtcctcgtcgtaagcgtagaagtcgtcgtcctgcagctcctgctcacaggggctcagagtgagacgcttgctggccgcgaagccagggtggttgaggatggcctctacgatgcgcacgtagcccttgctgatggcgagcagcagggcgtcgccaatgcgcgccaggttctccttcttgagcagcagctcggtcacctccaggtgctcgttgcccacagccagctgcagcgcgttctggcccatgtagtccacgcagttgacgttcagcg

SEQ ID NO: 792 - DNA, 25 bp, Homo sapiens
ttttgctacttgtctgggtctggtg

SEQ ID NO: 793 - DNA, 24 bp, Homo sapiens
gttggaactccaacacacacttga

SEQ ID NO: 794 - DNA, 175 bp, Homo sapiens
cctggaccgtgtcgtagaggccgatcctgagagaggcggagctgatttgccgctgaagccccgcaggcagcccgctgtagagtttcatccgcccttctgtttttaccacagcggtgattgttcccaggacacctttatacctaataacactggacgtcgggcattcaccttggac

SEQ ID NO: 795 - DNA, 117 bp, Homo sapiens
ggagccggactttggccgtgtccagcgggaaggtgatcacgtccgccaagcacgccgctattccagctgagaagagctggacccccagggtcgggtgtacgtccgaggctgtcaggc

SEQ ID NO: 796 - DNA, 108 bp, Homo sapiens
ggtccgtctctcgccgtctacctgttgcagcgcttgccaccgccacgaaacccctgctgcggagcccccctaaatccaaccacatccaggccagcgagtgccgctctc

SEQ ID NO: 797 - DNA, 43 bp, Homo sapiens
cgacgggaacgagcgcgatcaccagggcgaagactagggctgc

SEQ ID NO: 798 - DNA, 49 bp, Homo sapiens
ggccagttcaaaagtcgttttggcatacggggacgctctccggggcagc

SEQ ID NO: 799 - DNA, 967 bp, Homo sapiens
accgctttcggaatcaatggcaaaagatggtccacactctgcggtgtggaccatctttgattgcagggagccgagattgcagggagccgagagttggactacagtgtagcgcagccaggcgtgatcactgcctgcctcgtcggcatcggaggcgctgacccacatgactacagtgccaggggccgcggcctcggacactgaggccttgtaatgctgttggctgaagagaggtggttggtcattgaggtcagcgacccggagtagcagcgtctcctccgtgctcagcggcggggaccccgcgtccgtggccaccagtagtaactcatacagatcgcggctctctctgtccaggggcccctccacgcaaaggaaaaatacccctggggggccgccgggtagcaacgcgaagtctccctctccgccttccaaggacagagagatgctcccgtctccaagacccacaccaagctcccctgtggcctcatcttccttctcccagtcaccgtccgcgtcagacaccgagacgcgagccacgtagtcgcccggtcgggcgccttcagagacacgggcgacgcctccctctgtgagaaagagcacgtgaattgctggccggttgtcattcacgtccagcacggcgatggacacgcgcaccgtggcaacctcaggctcggcgcctccatcgcgggcctccaccaccaactggtgccaggcctgtgcctcgcggtccagaggtctccacactcgcaccacgccgctcagctcctccaccgcgaagtaggccgcgtcgcccagtgccccgccgccgctacccgccccaggcacttgccgggcgcggacgctgtagcgcacgaagccattgggccccaggtcgcggtcggtggcgcgcacgcgacagacctcggcgcccggctgggcgtcctcgcgcaccgcggcgcggtactcgtcctgctcaaagaccggcgggttg

SEQ ID NO: 800 - DNA, 75 bp, Homo sapiens
gaaaggagggcaggtatcgagagcccccgcccacccctcccggctacattggaattcccattactgactttccag

SEQ ID NO: 801 - DNA, 32 bp, Homo sapiens
gcggctcgcgctcggccgcggagtcctggcag

SEQ ID NO: 802 - DNA, 24 bp, Homo sapiens
agagacgggtactggagaaaatca

SEQ ID NO: 803 - DNA, 24 bp, Homo sapiens
agttcaacagattctgacagtgaa

SEQ ID NO: 804 - DNA, 48 bp, Homo sapiens
ttctggttcgttcttcttctttgagcctgttggcctgccagggccctt

SEQ ID NO: 805 - DNA, 39 bp, Homo sapiens
gtcttgctgaggtagctcgtgctggtgttcatgcactgc

SEQ ID NO: 806 - DNA, 31 bp, Homo sapiens
tcccgtggcatgcattgagtctttctccact

SEQ ID NO: 807 - DNA, 35 bp, Homo sapiens
gaaaggtttgggccgaatattatgcttgtgttcaa

SEQ ID NO: 808 - DNA, 66 bp, Homo sapiens
taccagtgacttctccgagtcgggagctagaaagaggcttccggccaggttcccttggaacaggtg

SEQ ID NO: 809 - DNA, 26 bp, Homo sapiens
cccgagcagggaccgggcctgccggg

SEQ ID NO: 810 - DNA, 61 bp, Homo sapiens
cagcaaacatccaggcggcggcagcagctctcaaggtacacttgtcctgtgagccgcagag

SEQ ID NO: 811 - DNA, 175 bp, Homo sapiens
acctgggctgctttgtatccgacccgcttgggtacccgcttgtgtttcctttgtctgtgggtccgtatcactttgctcccttctggaattccacttagatgagcgtcggccctttcatccctctccctccgtctctgtaccttttcacatctctccgtgtatgtttgctctattc

SEQ ID NO: 812 - DNA, 27 bp, Homo sapiens
agatgatgctatcctggggaggctgct

SEQ ID NO: 813 - DNA, 81 bp, Homo sapiens
gtggatgtcggcaccctggagccattgctttctccacacgtggtctctgagctgcttgacacgtacatgtccacgctcact

SEQ ID NO: 814 - DNA, 80 bp, Homo sapiens
acttcaaacaagtgtgaagaggctgtgtggcgagattgtggaactgaagcagcacctggagcactacgacaagatccagg

SEQ ID NO: 815 - DNA, 155 bp, Homo sapiens
ctgcgtgcttgtagccggacacatagcctgactcgtccaccagatccacgcggccagccttgcccttgcccttgccagaggggtcgaagcgctccttgtgggagcccgtgaacttggtggtgtccgtgagcctcgacactgtgggcgacgagatg

SEQ ID NO: 816 - DNA, 86 bp, Homo sapiens
accatctatgaggtcgtggatgcctcggtcaaccactcctcgggcagcagcaagaccctccgtgtgaagctaaccgtcagccctga

SEQ ID NO: 817 - DNA, 27 bp, Homo sapiens
ccagggcagatgtgccactgacttcaa

SEQ ID NO: 818 - DNA, 50 bp, Homo sapiens
gcctgggctttgcacgcgagtcctggcgccgagagcgttccgcgaagcct

SEQ ID NO: 819 - DNA, 30 bp, Homo sapiens
gaaacaaaaaccggcacatgcggttactgt

SEQ ID NO: 820 - DNA, 104 bp, Homo sapiens
tcctgagataatgaagccgttcattcttgggcacaaaagttcgaatggaggcctttccccgccatccgcataagacgatgggacactgcagagcgtctggattc

SEQ ID NO: 821 - DNA, 67 bp, Homo sapiens
caagccctttgcacacctacatcacagggacagcatgaccacagagaacggcaagatcagcaccacg

SEQ ID NO: 822 - DNA, 122 bp, Homo sapiens
gtggatgacagtcgcatcgtgggattgctgctggtaccgctggcagtaagtatagacgagcagggtgaggaggcagccgaggatggagctgctcagccccacggcgatcatgtggaacatgt

SEQ ID NO: 823 - DNA, 25 bp, Homo sapiens
agatctgtaactggctccctgtttc

SEQ ID NO: 824 - DNA, 60 bp, Homo sapiens
tttgactttgggactatttgctaggaggtggcgaagtttcacataactcttccacagttt

SEQ ID NO: 825 - DNA, 24 bp, Homo sapiens
ggagtttggagatggatcggatga

SEQ ID NO: 826 - DNA, 81 bp, Homo sapiens
taaagacagtgatgaggccgaggacgctgagctctatgatgacctttactgcccagcatgtgacaaatcgttcaagacaga

SEQ ID NO: 827 - DNA, 24 bp, Homo sapiens
cttgggcttgccgctgttctctct

SEQ ID NO: 828 - DNA, 26 bp, Homo sapiens
tccttgggccttcgggatggagccct

SEQ ID NO: 829 - DNA, 24 bp, Homo sapiens
tctctgttcctcccgatgggagga

SEQ ID NO: 830 - DNA, 25 bp, Homo sapiens
tagacatccttatcagcacagcact

SEQ ID NO: 831 - DNA, 54 bp, Homo sapiens
ccggcccgctacgccaatgtgccccccgggggcttcgagcccctgcctgtcgcg

SEQ ID NO: 832 - DNA, 365 bp, Homo sapiens
ctcatgggcaaggttctaacacgcaggagcgctttcttccttcatactgaatttactccagtactaggctgttaggaagtgacagtttcttctgtgtcttgcaatgccaagggaggaactgaattctgaattgattcttcatctgggtcacaagggaaaccagcatagtgaaagagtcacttgatctcttttttgcaattccatagtaacagctttaaaggtttctgacactcgaagagcgcaggtagagagagagaaaaagaaaatgaccgggaggtactgtaacacgggagagctgtcaaggaagttccatttcagggcaagcacaggaaaacactcctctccgtggagcaaagaagtcagcc

SEQ ID NO: 833 - DNA, 117 bp, Homo sapiens
tagatcccataatagatcacgttcaagacagaaagacagacgtagatctaagagcccacataaaaaacgctctaaatcaagggagagacggaagtcaaggagtcgttcgcattcacg

SEQ ID NO: 834 - DNA, 25 bp, Homo sapiens
ttgaccacatattatcccctccacc

SEQ ID NO: 835 - DNA, 28 bp, Homo sapiens
tgccaatatcttatcatctccctctaag

SEQ ID NO: 836 - DNA, 33 bp, Homo sapiens
actgaaaagccatcgactccagtccagacaaga

SEQ ID NO: 837 - DNA, 117 bp, Homo sapiens
tgtgggccgtcctgaggttagccctgcggccgtgtgcccgcgcctctcccgccgggccgcgcgcctatcacggggactcggtggcctcgctgggcacccagccggacttgggctctg

SEQ ID NO: 838 - DNA, 24 bp, Homo sapiens
tcagccgtcgcaccttccagccac

SEQ ID NO: 839 - DNA, 26 bp, Homo sapiens
ttttgatatggtgtccttagttttta

SEQ ID NO: 840 - DNA, 31 bp, Homo sapiens
ataattgatgtgatccggaaccagccaggga

SEQ ID NO: 841 - DNA, 151 bp, Homo sapiens
cagagactctcactgcacgccggagggcgcccttcctcgctcgcgcccgcgcgaccgcgcgccccagtcccgccccgccccgctaaccgccccagacacagcgctcgccgagggtcgcttggaccctgatcttacccgtgggcaccctgcg

SEQ ID NO: 842 - DNA, 97 bp, Homo sapiens
cgtgccaacgccatcgagaaatgggtggcagtggcggacatctgccgatgcctgcacaactacaacggcgtgctggagatcacctcggccttaaaca

SEQ ID NO: 843 - DNA, 31 bp, Homo sapiens
gcgaatggtcacagttggtcgctgggcaaag

SEQ ID NO: 844 - DNA, 81 bp, Homo sapiens
ggacgaaggtgactctctggatggaccagaatacgaggaggaagaggtggccataccgttgaccgctcctccaactaacca

SEQ ID NO: 845 - DNA, 74 bp, Homo sapiens
ggctacccctgcagagtagagacgtgtatagtgggggatatccactgggagccccagtcccaggtgaaagcaca

SEQ ID NO: 846 - DNA, 91 bp, Homo sapiens
gccgccaacgtccctgcagccaggcgcgcccccggccgcccgcgcctggccgggggagcgtcgctgccacgggatcttcgcgcccctgccg

SEQ ID NO: 847 - DNA, 141 bp, Homo sapiens
acagttataggagtaccggccataaaggtaaaaataattacaataaagaaaatgcaaaggaatatgggcagtttcgcacaatgagtttcacattttccagctttagcttcaaaaccaaaagtttctgcagtggatgttatt

SEQ ID NO: 848 - DNA, 41 bp, Homo sapiens
attctcttatgtagggcttaaggtgggacattttgataggt

SEQ ID NO: 849 - DNA, 39 bp, Homo sapiens
gagcatgcagggcccgcggaagaagcagtcccggctccg

SEQ ID NO: 850 - DNA, 101 bp, Homo sapiens
actgtcatttgaaggtggggcatcaggatcaggctcagaggaaggagctgcagatgcttcaataaccgcaggtgggaaatgacggcggcacacagggcatg

SEQ ID NO: 851 - DNA, 76 bp, Homo sapiens
taagggttaacttggattcatccaggagcaaaacttcgcagtaaaattcttccggaacagcgcagaaacagcccat

SEQ ID NO: 852 - DNA, 103 bp, Homo sapiens
cggttgtggtcgtctccagccaggagagaaagctaccaccgaggcgcccagccgccccctccactcaagcgcgatgcattaatttattgtccgcgccgtggcg

SEQ ID NO: 853 - DNA, 25 bp, Homo sapiens
tatatcctgcatgcagtgctcctta

SEQ ID NO: 854 - DNA, 75 bp, Homo sapiens
gactgacagctccaaaacggacacgctgaatagtagctcaagtggcacaacagcctccagcctagagaagatcaa

SEQ ID NO: 855 - DNA, 69 bp, Homo sapiens
atggtcagttggagtgcgtacgctggatggtgagcgaaacagaagccattgcagaactgagttgttcta

SEQ ID NO: 856 - DNA, 31 bp, Homo sapiens
cgttgttagcagggcaataggtcgtaataac

SEQ ID NO: 857 - DNA, 1865 bp, Homo sapiens
gaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctt

SEQ ID NO: 858 - DNA, 87 bp, Homo sapiens
ttcgcgcgaccctcgtcggtgccacacggggcgggctacgagctgctcatccagaagttcctcagcctgtacggcgaccagatcgac

SEQ ID NO: 859 - DNA, 103 bp, Homo sapiens
tgcatccaacaaactgccctggagctagttggccgaggagtcgaggttcacattgttgctgatgccacctcatcaagaagcatgatggacaggatgtttgccc

SEQ ID NO: 860 - DNA, 90 bp, Homo sapiens
tgccgagccggatggcgacgaagtgttgctgcggatcccggccttctctcgggacctgtacctgctgctccggagagacggccgcttcct

SEQ ID NO: 861 - DNA, 58 bp, Homo sapiens
aagcctgagaaatcagccaccacgttcccatgggtgagcatcgcaccttttgggttcc

SEQ ID NO: 862 - DNA, 80 bp, Homo sapiens
ggttacttctttctggacgagcggctctactgtgagagccacgccaaggcgcgcgtgaagccgcccgagggctacgacgt

SEQ ID NO: 863 - DNA, 596 bp, Homo sapiens
ttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatg

SEQ ID NO: 864 - DNA, 111 bp, Homo sapiens
tctgagcctctctcgtgtgcttttctggcacatttttcttttcccccttgggcggctctgtttctttgtaaggctttcctggtattctagtcaaaagattcaggtcaatct

SEQ ID NO: 865 - DNA, 25 bp, Homo sapiens
cttggcctttctttctacattggtt

SEQ ID NO: 866 - DNA, 36 bp, Homo sapiens
aaatatgtgagttgagtacggttgggctcggtgaat

SEQ ID NO: 867 - DNA, 24 bp, Homo sapiens
acattagagtttgttttattgcat

SEQ ID NO: 868 - DNA, 90 bp, Homo sapiens
cagcggggacatgctcactatcaacgggaaggcgatcatctccaataaagacatcctagccaccaacggggtgatccactacattgatga

SEQ ID NO: 869 - DNA, 52 bp, Homo sapiens
ccttctatgattggctgtaacatctgaccccttcgcttggtggatggagatc

SEQ ID NO: 870 - DNA, 24 bp, Homo sapiens
aagaataagttcaagggttgcttc

SEQ ID NO: 871 - DNA, 27 bp, Homo sapiens
ctgggctggactcccgtgctcctcagg

SEQ ID NO: 872 - DNA, 42 bp, Homo sapiens
tgctactttccgaacatagttatgtcgcttttccattcttaa

SEQ ID NO: 873 - DNA, 32 bp, Homo sapiens
ggactgaaaggcggtttactcgtgacttaatg

SEQ ID NO: 874 - DNA, 62 bp, Homo sapiens
gggagacaaagcagcgcccgtctgcttcgggcctctggaatttagcgctcgcccagctagcc

SEQ ID NO: 875 - DNA, 37 bp, Homo sapiens
ggtgcagaatctcggcggggagcttgttgtctctggg

SEQ ID NO: 876 - DNA, 120 bp, Homo sapiens
tctccgtgaccaggtcgtagagcagtgtgaccacgcgcacggcgagcacctccgtgcccttctcctgcaccagggtcctcaggacctgcagccccccgagcttcaggaactgccgctggg

SEQ ID NO: 877 - DNA, 36 bp, Homo sapiens
gcggcgagtccgagcgcagcgcgtcgtgcgccccac

SEQ ID NO: 878 - DNA, 145 bp, Homo sapiens
attccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcag

SEQ ID NO: 879 - DNA, 43 bp, Homo sapiens
tcctgaagccggtgattcccaatctcctgtcccgcgacagcga

SEQ ID NO: 880 - DNA, 58 bp, Homo sapiens
gcggggaccgcagtcggctgctgctgctgctgtgcattttcctggggacgctgcgggg

SEQ ID NO: 881 - DNA, 24 bp, Homo sapiens
ctgctgcttgtggcgctttcaaga

SEQ ID NO: 882 - DNA, 116 bp, Homo sapiens
ctttgacggtcaagtagtccctggtcatgatatacctcccactgtggctgaacttcacatccgaaatcgaagagataatttcagagaaaaatgatctgttgcttggatcttccggc

SEQ ID NO: 883 - DNA, 25 bp, Homo sapiens
gtggccaccacgtggaattattaag

SEQ ID NO: 884 - DNA, 29 bp, Homo sapiens
cgatacagttggatccttggaaggagttt

SEQ ID NO: 885 - DNA, 169 bp, Homo sapiens
tccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccc

SEQ ID NO: 886 - DNA, 136 bp, Homo sapiens
tgtggaagtggacgatctgccatttgccatcccggcggtgccagacacgggtctcctccgactgggcggtgcgtgggatgccgccagcgtccaggtactgcgtgatgcggatgtaggcgatgcaggctgactcgtc

SEQ ID NO: 887 - DNA, 25 bp, Homo sapiens
tggggagagatatccaggagtccct

SEQ ID NO: 888 - DNA, 41 bp, Homo sapiens
ttcatgtagcgaaggttgggaattgacatgattctcacttc

SEQ ID NO: 889 - DNA, 124 bp, Homo sapiens
ctgccatgcccacatctctagacgtccagcgacaaaatccacatgccaggtaataggctttcttcatggtggtcttggctgggtcatctggaagctgtgtggagatgctcgtggcccgagtaga

SEQ ID NO: 890 - DNA, 124 bp, Homo sapiens
gaggcctcgggtcgcagacggacgcacgggcgcagggactcgaggacgcagcgctcgctggatcggagcccgttagcccagcagcaaccgcagcgcggggcggaccgggaggacagccgtgggc

SEQ ID NO: 891 - DNA, 153 bp, Homo sapiens
gctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaa

SEQ ID NO: 892 - DNA, 28 bp, Homo sapiens
gtagctgaaaggcgtcctggatgtagga

SEQ ID NO: 893 - DNA, 162 bp, Homo sapiens
ctcgttttatactcccagggctccttattaaaatatctaaaaggtccaagaaattaataaggatagacatattaagttttctcagttctttcttgtgatcaaactgcataggatgaagccgttcgatgccctgactttccaaagggcggatgataagatcat

SEQ ID NO: 894 - DNA, 117 bp, Homo sapiens
gagcgcatccagcgcctccgccgtctcatggtggccaaagaggaaggggacggggccgcaggagcgggccggaggggtccgggtcggagcaggaaggcgccacgcaacgtgctcacg

SEQ ID NO: 895 - DNA, 28 bp, Homo sapiens
agagagtgtagcagctccgcacgtcacc

SEQ ID NO: 896 - DNA, 102 bp, Homo sapiens
tctgctgcttttgacactgaatgtcaaatcagtactgattgtcgtcagccaccagcaggtgaaacgtccagaataattcttggcctcgcatcttagaaaggt

SEQ ID NO: 897 - DNA, 90 bp, Homo sapiens
aggtagacggccaggtgccgggctgcagggcagagctggcagtggctgctcagcagggtcaggatgtccacgaagaaccggcggctcttc

SEQ ID NO: 898 - DNA, 67 bp, Homo sapiens
gcgtgtaaccgaagtgaagactgatatcttcgtcaccagtttcggacccgtttcagaccatgatatg

SEQ ID NO: 899 - DNA, 24 bp, Homo sapiens
tggagtccgagaggtggcaggcag

SEQ ID NO: 900 - DNA, 176 bp, Homo sapiens
cttctacaaacgaggagccgtccgtgcactggaagacgtatttccgccgcttgctgcgggtgggctggcagcactggggcccacagcccccacgacattccatgatgggcaccttggaggctgtggcacatgatgcataacctttctggcggcggatcacctctcggactacttgt

SEQ ID NO: 901 - DNA, 128 bp, Homo sapiens
gtgctgcagagcacccaaccattgccaagtcggtggagaacttcgtgaacctggtcaaaggcctcctggagaagctgctggattaccggggtgtgatgacagatgagagcaaagacaaccgcatgagc

SEQ ID NO: 902 - DNA, 70 bp, Homo sapiens
tggtttatctttctaagagcagcttctgcctctggtcgggtaatataagaaacgtaccactcttcattta

SEQ ID NO: 903 - DNA, 46 bp, Homo sapiens
ttgagagaagtatggtggcagggaggcactctgtggaaaactgctg

SEQ ID NO: 904 - DNA, 31 bp, Homo sapiens
gacagggacagttaggaacaggctcacacac

SEQ ID NO: 905 - DNA, 32 bp, Homo sapiens
tttttcggcaagtctcgctcttgtgccccagg

SEQ ID NO: 906 - DNA, 32 bp, Homo sapiens
catggctcactgtaacttctgcctcccgggtt

SEQ ID NO: 907 - DNA, 208 bp, Homo sapiens
cttttcggctctagggtccttggctgggtcggggtcgctgtaggcacgtggatagaaggcgggggcggcgggaaaggcagacgcacacttggccggtgaaggcgcgcggcccagctctgcgcgcagctctgggaggcccggcgcagccgcctcgggcccagcgtaggcctctggcttgaaggcggccagcatgcaggaggagggcgcc

SEQ ID NO: 908 - DNA, 154 bp, Homo sapiens
cccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaag

SEQ ID NO: 909 - DNA, 24 bp, Homo sapiens
attcgatccgcggcgctgccttcc

SEQ ID NO: 910 - DNA, 102 bp, Homo sapiens
gattcagggaacaatggcgtcatcctgttctccatcctccgagtagacttcatctctaaggacggggccaccatccctttccagggtgtcttctcgatcttc

SEQ ID NO: 911 - DNA, 79 bp, Homo sapiens
caagcccgtctggtgacaagggaaagagaagctgaagccaagctgcagaccctgtttgttcacaggctgcgcatccagg

SEQ ID NO: 912 - DNA, 79 bp, Homo sapiens
gtcgtggcccagtcgcactacctggggaagacccacgcaaagaacttaaagctgaagcagcagtccactaaggtggaag

SEQ ID NO: 913 - DNA, 74 bp, Homo sapiens
tgacctccagcaacgatgatgaggaccccaagtcccatagggacccctcgaataggcacagttacccccagcaa

SEQ ID NO: 914 - DNA, 31 bp, Homo sapiens
ggcgtccaccacattgactactataagaaaa

SEQ ID NO: 915 - DNA, 390 bp, Homo sapiens
gttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggca

SEQ ID NO: 916 - DNA, 78 bp, Homo sapiens
tgggggggtcgcttcttcctcctgtggatggggcctggactgcgatgcgggcacagggacgcataaccatgctcggcc

SEQ ID NO: 917 - DNA, 75 bp, Homo sapiens
gcaatgggatgtccaaccgcttctggggctggggccgcgaggacgacgagttctaccggcgcattaagggagctg

SEQ ID NO: 918 - DNA, 438 bp, Homo sapiens
gaggaatcctacccaggcctgagtgcctccatccagatgcacagccccaggtctcctcttgctgagacagctcctcctccactccaaccccatgtttcattctggggtctacacgttcttccacactgcccaatccccaggttatgggggttgactgaggggaggaaatctcccgcaaaccaggcaaagcccagggcttcatcatcctctttggacttcggatgagagaataagtttagtccctttctagagctagaaccttctcggtggctgtttcccaccatgggaagcgagtctggtctgtggtgaggaagcatgaagctcacatgctggaatcggggtagagctgggtccagttccttctcaaggccagccccaccgacgcggagcatggtcttggcaaactccctgccactgactgttcaccgtggacccggg

SEQ ID NO: 919 - DNA, 89 bp, Homo sapiens
tctgcagcgtctcccggccgtcctcgtctctgtactcccactccacgcccatggcaatgaaggttttggaactggcatccacgtcattc

SEQ ID NO: 920 - DNA, 55 bp, Homo sapiens
gaagataaatttggaacgttttcaaagggaaagcaaaattcgtgaaaatacttat

SEQ ID NO: 921 - DNA, 62 bp, Homo sapiens
cattctccgtcttctcatggcctctcaactctcctgcaggacccatctcttgtctactcctc

SEQ ID NO: 922 - DNA, 25 bp, Homo sapiens
tgcccacggtgttggtgacgcccac

SEQ ID NO: 923 - DNA, 55 bp, Homo sapiens
tctcgggctccttcgcggctcgagggggtctgcccgttcggacgctggggctcct

SEQ ID NO: 924 - DNA, 91 bp, Homo sapiens
cacctggtcactgctccacctcatgctgagaggagcctgtgtgtcaaaccccaggggaaaaagggacaggcagatcgaattctgtcttcta

SEQ ID NO: 925 - DNA, 206 bp, Homo sapiens
atcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacc

SEQ ID NO: 926 - DNA, 233 bp, Homo sapiens
cacatctggcgaattatctggaccatgttggccagctgcaagttgggacgaaagctgcgacgtgtaaagctctttcggcactgggggcaggtgaactgccctggaaggggcaaggaaggaggcgggtggatgtcaggatacagctcttcatcttcgtcctcatcgtatgcttccagtatttcttcttctcggtagacatcaattctcaggtcaggtctcaagcctcctaggta

SEQ ID NO: 927 - DNA, 139 bp, Homo sapiens
catctgggttgcggtgtttccctttgcccctaggagaaccatggccagggcagaggagatgctcacaggagaacagaacacgttgtgcgaagggttatcttgacacagtatctttaaaaggcgtatggcaaaagtacca

SEQ ID NO: 928 - DNA, 63 bp, Homo sapiens
gcagatcacgcttgcgaaggcggtctcgatcacgcggtggtcgtagacgaaggagcagaagca

SEQ ID NO: 929 - DNA, 127 bp, Homo sapiens
gggatggcaactgcggtcaccctgctaaagtcggggcgggggcggcggtcctccccctcaccccccccagtccgagcgccgccgccgccgccgccgccgccgccgcggccgctcagtaacacgtccc

SEQ ID NO: 930 - DNA, 266 bp, Homo sapiens
gtgggagggagaacgctttccaacctcctccaccaaggactctcacaaactcgcaatcgggctcccggagtgctggaacgcccctgtgtgacgtccgcccgcgccgggggaactccgcagagacaggtgcagcccgcgaggcccgagcgaccctactgtgggtgcggtgtcttcccagagagtggtgaagttaggaaggtacgaccccctaggccgaacagcctgtgggctagctggcgcctcctgccgcagtaaacacaaagtgg

SEQ ID NO: 931 - DNA, 77 bp, Homo sapiens
ctggcctcatacacctcaggactggaaactctgctgaacatacctatcaagaggaccatgattcagtccccttctgg

SEQ ID NO: 932 - DNA, 144 bp, Homo sapiens
ttgagcccgccaaaaagttatgagaagctgaacagttccagtgaaaggtattttaggaaaactgcctgtaatcacgccttagagaaaatgccagtctttttgtgggaaaatatattaccatcacctttgcgaagtgtcccttgc

SEQ ID NO: 933 - DNA, 795 bp, Homo sapiens
gagtggctcgttcccgtaaactggaggcttgatttaggagttgtctgatgttgtcttgtacttttcctgattgatttacccaaaagcaacatttttcatctaaggccaaacaaattcctccctgtgctgccgttaacatgtctagtcctcgacgattttgaaggactacggctgctaaagagtcgatttgttcttgcatggtcgttaaggctttagccatggtgtcaatgttgttggctatttcctttgagagctggctataggtgagggaagcttttgtgattccagcaattccggttcccgtaccagctagaatgccgagtcccgcgagaaggggaatgaaatggattgccctcctcaccctgggcaacggggaattcccatagattggtattggaagagagagattgccaggggctatgaagatgtctggggttacatagcctatggtacaagttccagtccagttactggggaggcattggtgaatcgactggccacaaatataaaaggctccttgagttttaaggcatgtagagatatggaaatgaaataagggggtgagggaggttccaaaaaattctgagactgctgatatgcccaggtagctggtggctatagtcatgcctgctaagacttggacgcagggtgtttggctctggttagctcccttggttttattttcccaaaaaagagaatttcgagtttggtccaatagaacccattccgctgtagagctgaggttggaaatttgcagacattggttataatcagcaggccggaaccagaagtttc

SEQ ID NO: 934 - DNA, 57 bp, Homo sapiens
gttgagactaagtggtccgggagaagcagaggaagccgtgccctgtgcgctgaccga

SEQ ID NO: 935 - DNA, 29 bp, Homo sapiens
ttctctattttgtccgggtgtcatatttt

SEQ ID NO: 936 - DNA, 155 bp, Homo sapiens
tggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtaca

SEQ ID NO: 937 - DNA, 57 bp, Homo sapiens
ggtgaagcgcgtctacctgttcggcggcctgggcacgtcgtcgtcgcccgtgggcgg

SEQ ID NO: 938 - DNA, 39 bp, Homo sapiens
cggcgcagctttgcgggcccgaccggctccgcgtggcag

SEQ ID NO: 939 - DNA, 34 bp, Homo sapiens
cacctgaggactgtcggcggcaagcctcagatgg

SEQ ID NO: 940 - DNA, 24 bp, Homo sapiens
gcttctcaagccctaaaaacaaac

SEQ ID NO: 941 - DNA, 156 bp, Homo sapiens
aaagggcctcggtgatcaacttggacacagagaggttcggcactttgcgacttgcacttatcaagccagccggcttcctccctcgcttcttggttggaagtttctccatagcggctacaccagcactggcagaagctgcaggcacggtttcagaca

SEQ ID NO: 942 - DNA, 74 bp, Homo sapiens
agttccccagtctcacagccatggaaacaagccctggccatctcagcagccactgcacaatgcctctggtggaa

SEQ ID NO: 943 - DNA, 130 bp, Homo sapiens
acgtgaacgggctcgcctggcaactgcccaggacaaggcccgctccaacaaagggctcctggccaggatctttggagccccgccaccctcagagagcatggagggaccttcccttgtcagggactcctga

SEQ ID NO: 944 - DNA, 25 bp, Homo sapiens
acccgctcttctcgtgccggtctcc

SEQ ID NO: 945 - DNA, 24 bp, Homo sapiens
gccttgggggctactgaatatctt

SEQ ID NO: 946 - DNA, 116 bp, Homo sapiens
aagagcacaacaagagtgatataggaggagaaaactatggcaagagaggcaaaggcaaaggctgcatcctgctggctggacagaatcatggtgacaggagcagtgatgaggcacag

SEQ ID NO: 947 - DNA, 29 bp, Homo sapiens
cccagcgctgggcattccccatctttgca

SEQ ID NO: 948 - DNA, 27 bp, Homo sapiens
gacaagtctgttagaggctggggcctc

SEQ ID NO: 949 - DNA, 30 bp, Homo sapiens
aacatgaagatatcctcccagggttgaagt

SEQ ID NO: 950 - DNA, 95 bp, Homo sapiens
acattgtagctccatcacccaggctggagtgcagtggcatgaacatggctcactgcagcctccacctcctgggtttaaaggatcttcctgcctca

SEQ ID NO: 951 - DNA, 56 bp, Homo sapiens
tggagttcccgttcgatgtggacgcgctgttcccggagcggatcacggtgctggac

SEQ ID NO: 952 - DNA, 28 bp, Homo sapiens
tggtgtcaggttctgtttacgtccttct

SEQ ID NO: 953 - DNA, 132 bp, Homo sapiens
atgtccacaggaaacctgcgtccggggattcgaaacacaggggcgtcatcaaagaaggtggaaaaacgggcagtgtccattgtggctgaagccaccaggaccttgagctcaggtcggaagcgagcaacatcc

SEQ ID NO: 954 - DNA, 41 bp, Homo sapiens
tccggtcttcctcggccatcttgaggcgcttctgagcctct

SEQ ID NO: 955 - DNA, 127 bp, Homo sapiens
aggaacttgactgtccggcggatgcgatcagtgaccaggtgggaagcctctgccgctgaaccagccagacttccccccagtgccagcacagcccgctctccccgagcatccaccactcctgtgaaga

SEQ ID NO: 956 - DNA, 129 bp, Homo sapiens
gacaaggcacaaactatttggcaaggagagatgaggggtgggacctcactgtcaatggacatgctcagggaggccagtgggttacatgcaacaggaggatcattcaggcaacttcagctatgaggctgg

SEQ ID NO: 957 - DNA, 27 bp, Homo sapiens
catccagggtgcccgagacgagcccat

SEQ ID NO: 958 - DNA, 87 bp, Homo sapiens
atacaaaatttagccgggaggctgaggcaggagaatcgcttgaacccgggaggtggagattgcagtgaggcgagattgagccactgt

SEQ ID NO: 959 - DNA, 37 bp, Homo sapiens
gcccgtgcttcgtgctttggactaccgcccagcagtg

SEQ ID NO: 960 - DNA, 43 bp, Homo sapiens
aaagggagtctgccgaacagtcgtctgggcccggaccaagcct

SEQ ID NO: 961 - DNA, 30 bp, Homo sapiens
tttctttagtctcaaaacaagagactagga

SEQ ID NO: 962 - DNA, 243 bp, Homo sapiens
agaaggacagggactacagtgctaggctgaggggcagccctgtgcaggcgccgccccgctgcgtcctggccaatcagctccagggagaagggtctaggggtggacagcagcgtgggcgacagcgaggctgcgaggagacctcgctccggaggtcccacgggctccaagggcacctggcctagttcggcaccctctgggacccctcgaaggatgacgtgggagaaatgcggctgaggatcccca

SEQ ID NO: 963 - DNA, 26 bp, Homo sapiens
ccatcctccatggggatcccaaagtg

SEQ ID NO: 964 - DNA, 67 bp, Homo sapiens
tgctgatgtctccgtggatccggactgtgatcttctggagcagcccatccacgctgaacacaagtgg

SEQ ID NO: 965 - DNA, 96 bp, Homo sapiens
gatgagttccaaagtagccagaggtgaggagtgtgaagcccagccaattcctggggcagctcaactcctcgcaatcggagcaggtaggatcggcca

SEQ ID NO: 966 - DNA, 190 bp, Homo sapiens
catgaagtgcagccccgaggcgctggcgagccagggtgtggtcaagggccctggctgccaccacggtctcccgcagagcccctaccaggcgcgcgcgtccctgacccagtcgctcagcatcaaagtgcaggtcggggtcattcctggaagttggcaggaagtcctgggctgcattggcacgagacacctc

SEQ ID NO: 967 - DNA, 69 bp, Homo sapiens
cacgaagggcaaacttggtggcattccagagcttgttgcagaagtggcggtaacccagtatccggttca

SEQ ID NO: 968 - DNA, 59 bp, Homo sapiens
atccccaccacgatgtaacctagaatgaagagcaggaagaggacgcagcagatgacatc

SEQ ID NO: 969 - DNA, 85 bp, Homo sapiens
agcacatggcagatctccacggagcccttctgggcggctgcatgcaggggcgtgcgcttgctctgctggtcgctctggaagttgg

SEQ ID NO: 970 - DNA, 135 bp, Homo sapiens
gggtactgctccaacccgggcatccccattggcacaaggaaggtgggcagccagtaccgccttgaagacagcgtcacctaccactgcagccgggggcttaccctgcgtggctcccagcggcgaacgtgtcaggaa

SEQ ID NO: 971 - DNA, 87 bp, Homo sapiens
tccaggcagtgtacagcatgatgagctggccagatgacgtccctcctgaaggctggaaccgcacccgccatgtcatcatcctcatga

SEQ ID NO: 972 - DNA, 42 bp, Homo sapiens
ctccgcgtgcggaagaaggaggtgtacatgccctcgtccatc

SEQ ID NO: 973 - DNA, 197 bp, Homo sapiens
gcgtttcccattctggagtccaaagagcaggaacttgtacttgcgggccgggtccagccccgagacggcgaccgctcggaggtctccgctcacaggcactgcctggggctgcccctgcgcgtccctgtactgtaccaggaaggagtcaaaggggccctgggccaccgtccatgagaggcccactgagtccgaggtca

SEQ ID NO: 974 - DNA, 46 bp, Homo sapiens
accagggacatcttgggccgggaggtcttgttgtggctgatggctg

SEQ ID NO: 975 - DNA, 29 bp, Homo sapiens
cacggactacttgaagtggctgttcccca

SEQ ID NO: 976 - DNA, 26 bp, Homo sapiens
ccacccaccagtctgagctgcttctg

SEQ ID NO: 977 - DNA, 71 bp, Homo sapiens
cagccagcatcaagggtgtggtcccgtcctctgtgcgagcgtccactgcagtttgtctgctacggagcaga

SEQ ID NO: 978 - DNA, 25 bp, Homo sapiens
cccaggggtgatcctgctgtggcct

SEQ ID NO: 979 - DNA, 31 bp, Homo sapiens
tccctccatgtggatgctaggggcagacccc

SEQ ID NO: 980 - DNA, 29 bp, Homo sapiens
cctggatagtcctgtcaccgtggagtgga

SEQ ID NO: 981 - DNA, 25 bp, Homo sapiens
tcccaccactcctggaggaccaggg

SEQ ID NO: 982 - DNA, 36 bp, Homo sapiens
tctgtccccgcagattgcacatagccgtttgccagc

SEQ ID NO: 983 - DNA, 75 bp, Homo sapiens
gatctgatagttggtcatgggtttcctgaaggaataaatcttctggaggataaactctcggatcttcgtcactgc

SEQ ID NO: 984 - DNA, 66 bp, Homo sapiens
catgttcctgcgcgtgctcatccacctcaccatgcacgactatgcgccgctggtctcgggtgccct

SEQ ID NO: 985 - DNA, 77 bp, Homo sapiens
cgcttgttctctgggtactcggagcacaggcgggtcaggtgggcctggtggcattgcaggccccacgggttgaagct

SEQ ID NO: 986 - DNA, 203 bp, Homo sapiens
agtcgtatgctcatcgtcccaggtcaagggggcatgccagggtggggagggcgtcaggccgctgctaggatgcgggccagcaacagcggacaggaggtggttcccacggcgctgggaggctcaggccggaggtgggggtgttgggggatgcggatgggccgccccgcgcccgaacatcctggaagcccgtcacccgaggcgtg

SEQ ID NO: 987 - DNA, 24 bp, Homo sapiens
caaaaattccaactaatcttccca

SEQ ID NO: 988 - DNA, 117 bp, Homo sapiens
gcacgaactggtagacgaggcgctgggagatgtctggcttccggatgatgcccttcttgtaatactggcggatggagcggctcagcttgtcgtagttcatggcgggacggttcttgc

SEQ ID NO: 989 - DNA, 139 bp, Homo sapiens
taccacggccagacggagcagtgtgtgccatgcccagcgggcaccttccaggagagagaagggcagctctcctgcgacctttgccctgggagtgatgcccacgggcctcttggagccaccaacgtcaccacgtgtgcag

SEQ ID NO: 990 - DNA, 90 bp, Homo sapiens
ctctgcttgcccaccgtgactcctccctaaagcgcctgacccgctggggatcccagggcaacaggaccccctcgcccaacagcaatgagc

SEQ ID NO: 991 - DNA, 96 bp, Homo sapiens
gtgctgcctgttggtttctggtgaactcatttcccctttccctgtctttgttcccacagaggccgtcagctgatctttaccgtggtctcttctgtc

SEQ ID NO: 992 - DNA, 69 bp, Homo sapiens
ccagagaagaagatcgtccaggagctgctggagacagagcaggcctatgtggcgcgcctccacctgcta

SEQ ID NO: 993 - DNA, 33 bp, Homo sapiens
tcttcgtcacaggagaccgcgccggtggccgga

SEQ ID NO: 994 - DNA, 121 bp, Homo sapiens
aggcagcatacgtcccagggacagtgggtttggatctgtctagaacagcggtttgtggctgtggcccagctccgagagtgatatttgctctggtaggtgagggcctgagggtacatttctc

SEQ ID NO: 995 - DNA, 84 bp, Homo sapiens
ctgtgtccctctgggagacggtgcagaaatggcgagaataccgacgccagtgccagcgctccctgactgaggatccacctcctg

SEQ ID NO: 996 - DNA, 131 bp, Homo sapiens
gctgcctttagagtcgctgctgcttccgccttctctcctggggtttgtgcgccctgactggcagcagggggttgggccgccagacccgcccgtttccgcgccgcccgaaactcagctaaccgctgttccat

SEQ ID NO: 997 - DNA, 50 bp, Homo sapiens
tcatggccttcttcccgatctgcttgatgaggtcgttgtaggtctcttcc

SEQ ID NO: 998 - DNA, 162 bp, Homo sapiens
ccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctgg

SEQ ID NO: 999 - DNA, 74 bp, Homo sapiens
caagtagacttccacatagggctctggtcttccaggtgggtcacgtgtagaaggatcgctgcacatgctgtagc

SEQ ID NO: 1000 - DNA, 24 bp, Homo sapiens
tcctgttagtgctcctgatctgca

SEQ ID NO: 1001 - DNA, 52 bp, Homo sapiens
cagaccggaggtgcgtcattcaccggcgacgccgatacggttcctccaccga

SEQ ID NO: 1002 - DNA, 30 bp, Homo sapiens
gtgccgggtgccttcgcaacacagcagctc

SEQ ID NO: 1003 - DNA, 24 bp, Homo sapiens
gaacagcacaaattcagaagattc

SEQ ID NO: 1004 - DNA, 28 bp, Homo sapiens
gtcccagcaatagcacgccgccccccac

SEQ ID NO: 1005 - DNA, 24 bp, Homo sapiens
ctggcacaggtatctgaggaacac

SEQ ID NO: 1006 - DNA, 33 bp, Homo sapiens
atccccggctccattacttgtaagggaattggg

SEQ ID NO: 1007 - DNA, 68 bp, Homo sapiens
tcagcatgactcccagcagtcagggtcttgtggcaacgctggcacctcagacacggtcggtgccaatt

SEQ ID NO: 1008 - DNA, 37 bp, Homo sapiens
gggtccagccttgcgctcgcagtcacgcccatggaag

SEQ ID NO: 1009 - DNA, 31 bp, Homo sapiens
agcggtaccggctggactgcaacctggctgt

SEQ ID NO: 1010 - DNA, 25 bp, Homo sapiens
tgggggaagttgaccatcttgatag

SEQ ID NO: 1011 - DNA, 27 bp, Homo sapiens
gagagactgactaaagaccgaaatgat

SEQ ID NO: 1012 - DNA, 25 bp, Homo sapiens
tgagagggcacgcttactctgtgac

SEQ ID NO: 1013 - DNA, 25 bp, Homo sapiens
catctcccgagaaatgctccagcag

SEQ ID NO: 1014 - DNA, 24 bp, Homo sapiens
cacgtaggttggattatcctgttc

SEQ ID NO: 1015 - DNA, 245 bp, Homo sapiens
atggccattgcagtagtagatccatttctcccggttctgggttggagtcatggatttcttcagccctgccttttccacaatggcactgggatcctgccggggcccctttttcagagtcctcgagcttttccggatactgcacaccacaatcaccacaagcaccagcagcaggaaaagcacaatcatccagggcaaatgctcattgatgtcaaaatgcttgtgtaggttctgtctaggatgtcccc

SEQ ID NO: 1016 - DNA, 36 bp, Homo sapiens
gagaagggagcccgcgatcatcgtggctgtggctcg

SEQ ID NO: 1017 - DNA, 26 bp, Homo sapiens
ctgcacaccgtaaccacagtcaggaa

SEQ ID NO: 1018 - DNA, 36 bp, Homo sapiens
cctgaatagtttccgggtgtactgaatgaaggcaga

SEQ ID NO: 1019 - DNA, 88 bp, Homo sapiens
gctcccgctccaggttccttgaagcacttccgaccgcgaagcccggcgcgagaagcgagctaacccaagagccaacaacgagcgcgga

SEQ ID NO: 1020 - DNA, 24 bp, Homo sapiens
acccagctgcgaagactagaagaa

SEQ ID NO: 1021 - DNA, 129 bp, Homo sapiens
atcagcaggagaagccgtctcatcattttcctcttgcagtgtgtcgtagtcctcagggtgcaggcaatcacgatcatcaccatcaagaagcaaagaatcatggtcatcatcttcaaacaagggagtatc

SEQ ID NO: 1022 - DNA, 29 bp, Homo sapiens
tgaacctggaattgggctgccagggagtc

SEQ ID NO: 1023 - DNA, 76 bp, Homo sapiens
acctgctcggcggggtcagcttccgcgagcccaccaccgtggaggactgcgactccacctggcagaccgactcgga

SEQ ID NO: 1024 - DNA, 108 bp, Homo sapiens
tcgagaccacaggggggtcaggtagccaaggctgggctttgacggtaggaatgaaggaggtgagggtggcgcgccgcaggcctgggccactccctgagtagggcggcg

SEQ ID NO: 1025 - DNA, 46 bp, Homo sapiens
gtttaaagctttgggcttaaatgaaaatgactacaagtttgggtta

SEQ ID NO: 1026 - DNA, 39 bp, Homo sapiens
tcctcggcgccgttcctggcttccgccgtgtccgcccag

SEQ ID NO: 1027 - DNA, 69 bp, Homo sapiens
tgactgtcgtctccgtcccgcagcgggagccgctcgtcctgggtggccgccttgcgccgcttggctttt

SEQ ID NO: 1028 - DNA, 24 bp, Homo sapiens
agtgggagctctgccaaaagttcc

SEQ ID NO: 1029 - DNA, 56 bp, Homo sapiens
ggattttgactttgagctggagagccgggatttggccccctttctgttgtcagtca

SEQ ID NO: 1030 - DNA, 64 bp, Homo sapiens
cttggtgtcaacgtgggaaagcccttgaggttttctgtcgctgtcaggaggaagcacgaaaact

SEQ ID NO: 1031 - DNA, 26 bp, Homo sapiens
ggaggcctgcagtccgcgcggccgcg

SEQ ID NO: 1032 - DNA, 94 bp, Homo sapiens
agggtctccctaagttgctcaggctggtcttgaactcctgggctcaagggatccttccacctcagcctcccaaagtgctggaatatgaggtgtg

SEQ ID NO: 1033 - DNA, 129 bp, Homo sapiens
tacactgagacttcgtcacacataaaacaagcacgacaaagaaagagggcgcgaagggactcctggaagaaattgagtctacatttaagatcaccctaaaagtagtgacggcctcttcattactccaaa

SEQ ID NO: 1034 - DNA, 24 bp, Homo sapiens
gaattcgtgacctgataccaggtt

SEQ ID NO: 1035 - DNA, 49 bp, Homo sapiens
catcctcgtccagctgcgactcagcgccttccacgtcctgtttgtattt

SEQ ID NO: 1036 - DNA, 44 bp, Homo sapiens
tccttttccactgctgccgagatggcgcgttttttagtcgtcac

SEQ ID NO: 1037 - DNA, 55 bp, Homo sapiens
agactgcgcgggcccggtagccctggagaggccgaggctctaggccgcgaggggc

SEQ ID NO: 1038 - DNA, 33 bp, Homo sapiens
tcaggggcgaaagcgtcgccagcgtcgccggcc

SEQ ID NO: 1039 - DNA, 149 bp, Homo sapiens
agcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcc

SEQ ID NO: 1040 - DNA, 46 bp, Homo sapiens
ccctggaactgaggggcgttcaacctgtatcatgcccagccaacta

SEQ ID NO: 1041 - DNA, 101 bp, Homo sapiens
atacaacgagttctctcttgctgaaatctttgtaaaaatggtccaacaagatggtatacataaagcaactggaattcggtcttcactataggaagaagtac

SEQ ID NO: 1042 - DNA, 88 bp, Homo sapiens
ccctttccgatcactttcaagaagtgaaagtcagatggtttagcatgaggattggacgacgggccaaggttgatttgctgagaaggac

SEQ ID NO: 1043 - DNA, 126 bp, Homo sapiens
ggagccgacacccggagcagtgcaaatcaactcccccagcctagcggcgcgtgcgcgaagtgaggcggccacgcagccacctaacccgccagcgacccgtgtcctgaaagcaagccgcggctctgt

SEQ ID NO: 1044 - DNA, 25 bp, Homo sapiens
cagagatgtgaagccagatcctcat

SEQ ID NO: 1045 - DNA, 86 bp, Homo sapiens
gcttcgggaactgccagcaacacggagaccacccagatacccatggccttcacacaggtccgcagcaatgcccctgacgtctgcat

SEQ ID NO: 1046 - DNA, 74 bp, Homo sapiens
tgtagcaagtaatactatccaacctactccacagactatacctgccattgatcccgcacttttcaatacaattt

SEQ ID NO: 1047 - DNA, 55 bp, Homo sapiens
tccacttttcggtctcctctgccgacaccgagcacgcgccgcttgcagctggctt

SEQ ID NO: 1048 - DNA, 82 bp, Homo sapiens
gcaggccggctgtcctctctgcaggctcccgcggcctcgggagcgctgttcttccgtctctgccgctgagtatgccgcgccg

SEQ ID NO: 1049 - DNA, 26 bp, Homo sapiens
aaatcttcttgtgcccgggccaaggc

SEQ ID NO: 1050 - DNA, 53 bp, Homo sapiens
ccatcacgcaaggtaggtggtatccctgggtgcctggctatcaacaattccat

SEQ ID NO: 1051 - DNA, 294 bp, Homo sapiens
agaaggtggtacatcactatcagcatgatttagagattcagcacagtcctctgtttcatgttcttggttgaattcagagatacatgtacttttagacatagcaacatcagttattccagagtcgctagtagctggacagtgaccttgtgaatcgggattgataaatggttgactttttcctttttttgtggatggaacaagctttttcctcaatttactgcgatttctcctggacttataataataatagtaaggatcatcatcatcatcagaggtgtctgatggcaagtattc

SEQ ID NO: 1052 - DNA, 66 bp, Homo sapiens
atggcaccttgactatatggaatgtaaggtcccctgctaaaccagtacagacaatcactccacatg

SEQ ID NO: 1053 - DNA, 30 bp, Homo sapiens
cattttaaccccagcgctattcataacttt

SEQ ID NO: 1054 - DNA, 34 bp, Homo sapiens
catcctgcccagccttgctaagtggaggcgcatc

SEQ ID NO: 1055 - DNA, 27 bp, Homo sapiens
aggactcggcgcccgtggccacggcgg

SEQ ID NO: 1056 - DNA, 33 bp, Homo sapiens
gacctcaagcgcaaacctctggaccagatcatg

SEQ ID NO: 1057 - DNA, 45 bp, Homo sapiens
gtaacagacataaacctggggaagctggtgcgaggggatgcccat

SEQ ID NO: 1058 - DNA, 146 bp, Homo sapiens
gctgggtgattgtctccaggctgcttgtctccaggaggtcaggtgccaccagtctgccagacatctgcagcagccacttttcgacctcttggagctcactgttgtagtcttcatggtctttgactttcgcctccagactgaagaca

SEQ ID NO: 1059 - DNA, 26 bp, Homo sapiens
tgggagggggctatacgcagaggaga

SEQ ID NO: 1060 - DNA, 164 bp, Homo sapiens
cggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgt

SEQ ID NO: 1061 - DNA, 47 bp, Homo sapiens
gctctgggcttcttgccacgcgggcgacacgcctatgatcaattttg

SEQ ID NO: 1062 - DNA, 102 bp, Homo sapiens
tacagggcctcgaactcgtcgatgcgctgcttggtgttgccctgccggatctgccgcagcgtcttgtacttgtcccggccttgcctcatgttctcgttgtgg

SEQ ID NO: 1063 - DNA, 29 bp, Homo sapiens
gtccaggggtggatttcactcccgtgtgg

SEQ ID NO: 1064 - DNA, 124 bp, Homo sapiens
ccctgtcaaccagctccgagccggcagcgaaacctgaagtggaccctgtggaaaatgaagctgtcgccccagaattcaccaaccggaacccccggaacctggagcttttatctgtagccaggaa

SEQ ID NO: 1065 - DNA, 107 bp, Homo sapiens
tctgagctccttaagtggcagggcgggattcacagctgcttacagcgagaaggggttggtttacatgagcatctgtggggagaatgaaaactgccctcctggcgtgg

SEQ ID NO: 1066 - DNA, 95 bp, Homo sapiens
agttgttgtcacgtactccaaaggttatccgtgtggtggaaataagaccgcatcctccgtgatagaattgacctgtacaaagacggtgggcagac

SEQ ID NO: 1067 - DNA, 30 bp, Homo sapiens
ggaggccagccagtcggtctaatttgaaag

SEQ ID NO: 1068 - DNA, 24 bp, Homo sapiens
gggcagtgtggggattggcattca

SEQ ID NO: 1069 - DNA, 30 bp, Homo sapiens
ggccccttggaccgagacctgcgacggctc

SEQ ID NO: 1070 - DNA, 24 bp, Homo sapiens
tgggtatcactccatatactctgg

SEQ ID NO: 1071 - DNA, 26 bp, Homo sapiens
caagtgcacagacaacaccaagtaag

SEQ ID NO: 1072 - DNA, 66 bp, Homo sapiens
gcacatacctcacgatcacgggaaacacacatgcagagaaggcgggaaagcgtggcaaagacatgg

SEQ ID NO: 1073 - DNA, 80 bp, Homo sapiens
gaccaagcctgcagtgccaccctccccagggagcaaacagaggcaggaagggcaggaaggagccgcagagcttctcaagg

SEQ ID NO: 1074 - DNA, 69 bp, Homo sapiens
ccattcccagggtcggctcctgctgactgcatgcaggcctctcaggactgggttccatacatcgcgccc

SEQ ID NO: 1075 - DNA, 50 bp, Homo sapiens
ccagtgtcacagctacacgggatactgctggtgcgtcacgcccaacggga

SEQ ID NO: 1076 - DNA, 177 bp, Homo sapiens
agattgaggttgggccagccgtccaggtccgagtcctccccgcagatgagcccgtcgcccgcgtagcctgtctggcactcgcacttgtacatggggtcgctgaagtggcccaggtagatgcactccgcgtgcttgtggcagttgtgtgtcttgtccttgcatgggttttcgggctca

SEQ ID NO: 1077 - DNA, 68 bp, Homo sapiens
cacagcaggtgtcccagtcaggctggcatcaaaaacgagtaacagatggttggccaacccacaggcca

SEQ ID NO: 1078 - DNA, 51 bp, Homo sapiens
ctcccgctgaagcgggttccaaggccaccgtgagggggaccatccatccag

SEQ ID NO: 1079 - DNA, 25 bp, Homo sapiens
atcaccgaggtccacacacttggca

SEQ ID NO: 1080 - DNA, 108 bp, Homo sapiens
tgctgtcgacacgcctcacgctgctgctgatggtggccacaccagccctgatgggagtgggcaccctgatgggctcaggcctccgaaaattgtctcgccagtgtcagg

SEQ ID NO: 1081 - DNA, 127 bp, Homo sapiens
ggaggagctagaccgcgtgctgggccctgggcggactccccggctggaggaccagcaggctctgccctacacaagcgccgtgctccacgaggtgcagcggttcatcacgctcctgccgcacgtgccc

SEQ ID NO: 1082 - DNA, 106 bp, Homo sapiens
ggcactggcgccagaggcttccttggggcggggggagggcacctcagcccctgaagacaagcagcactgcagtggcaaaaatggaaacactgacccggtgcggtgg

SEQ ID NO: 1083 - DNA, 88 bp, Homo sapiens
ctgctcaggcattcggcaggtccagcagaggtacacctcctgcagcgggttccaagtgcacctccagcctgatgggcctgaccaagga

SEQ ID NO: 1084 - DNA, 25 bp, Homo sapiens
ttagtcgggtgccaggacaatgaaa

SEQ ID NO: 1085 - DNA, 114 bp, Homo sapiens
tggtttgccctgaaggtgaggtttcttctcctcctccttccagctctgcactcgggcttcctggccagggggctccggccgaagccagttgtcacaaacgtcgaggctggcagg

SEQ ID NO: 1086 - DNA, 115 bp, Homo sapiens
gatagtggaggcttccgggctggggcgggcgagggcagcttggccgcctggactggagccttcttccctgacggctcctcctcagagtcctccgaggccctcttcacgcctgcca

SEQ ID NO: 1087 - DNA, 138 bp, Homo sapiens
gcagcaggcggatgaaggacagaaggcagtcccacagcgccccctggtgctcgctgcggaacacgtgcggctgcagcagctccagcaggcccagcacgtgcaggaagcagctcaggtggttctgctgccggaactcct

SEQ ID NO: 1088 - DNA, 105 bp, Homo sapiens
tgatgttctgctccagagtctgggggtcgtgggccactgcctggtccaggaactggaggagtttgctcatgctggacacggggatgccaaacgactgcacgaaca

SEQ ID NO: 1089 - DNA, 35 bp, Homo sapiens
tgaggtgggacttcgaacggatctgctctgctctt

SEQ ID NO: 1090 - DNA, 88 bp, Homo sapiens
gctgctgaacagccgcaaaccatcttcacctgggggcattgagtggcgcagagccgggtttcatctggaattaactggatggaaggga

SEQ ID NO: 1091 - DNA, 73 bp, Homo sapiens
cggcctccggcccgtccgagtcgccctcgccgccggccgccgaggagctgcccgggtcgcatgctgagccccc

SEQ ID NO: 1092 - DNA, 55 bp, Homo sapiens
gacagctgccccatggcggtcactgcactcgctcggacataactctcagggtcct

SEQ ID NO: 1093 - DNA, 27 bp, Homo sapiens
tgggtcaggaactcgagggcggagtcc

SEQ ID NO: 1094 - DNA, 27 bp, Homo sapiens
tccacaaacctccacccacatcgccaa

SEQ ID NO: 1095 - DNA, 90 bp, Homo sapiens
ggcaggcgcacgacagcctctaccgcgtccacatgcccagcctgtacagctgtggcagcagctacggcagtgagaccagcatcccggccg

SEQ ID NO: 1096 - DNA, 44 bp, Homo sapiens
atatggaaaatctcaccagccaggatgaggtacccagagatacc

SEQ ID NO: 1097 - DNA, 31 bp, Homo sapiens
tacttacgtgccttcatccccaacgagactt

SEQ ID NO: 1098 - DNA, 518 bp, Homo sapiens
cctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttt

SEQ ID NO: 1099 - DNA, 164 bp, Homo sapiens
gagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattc

SEQ ID NO: 1100 - DNA, 64 bp, Homo sapiens
ctctctctctactccccggggtctctcctcgacccccatctcctggggtatcccccgctcggat

SEQ ID NO: 1101 - DNA, 29 bp, Homo sapiens
gatgaacagcatatactgaagggggtatg

SEQ ID NO: 1102 - DNA, 78 bp, Homo sapiens
aggcacctcttctaatgtttggaatgaagtttcactgggtttcatcgtgtaaaacaacatgcgaaatccctgggaaac

SEQ ID NO: 1103 - DNA, 128 bp, Homo sapiens
ctaatgccacgataggtgctgttagtcctgaccaactcacacaagtgcatttgcagcaaggccagcagacttctgatcaagaggtacaacctggcaagaggcttcgaagagttgcctgttcctgtcct

SEQ ID NO: 1104 - DNA, 73 bp, Homo sapiens
cgtgcagcggcttcccgtaggagcagcgttctgccgggcttgccagaccccaaactttgtccgcggcctgcac

SEQ ID NO: 1105 - DNA, 96 bp, Homo sapiens
agccgccgccacagtagatgctttcatgccatttcccaaacagccgatgaaccgcttttccactcctgtcaaacactgtgccttcaatctcatggg

SEQ ID NO: 1106 - DNA, 65 bp, Homo sapiens
cacaacgaacactcccgctccgaagccggacgtccccactctctaagtccaaggacacgccggtc

SEQ ID NO: 1107 - DNA, 41 bp, Homo sapiens
ttcctgatttaacgcgtaggggctgtaaggcgcactgaagt

SEQ ID NO: 1108 - DNA, 24 bp, Homo sapiens
gcagcgacgcgaggggcgcgcgga

SEQ ID NO: 1109 - DNA, 893 bp, Homo sapiens
accaacagtggctgcgggactttccagcacctagcctgggcattcccacagcccagagggagctcgtcccagacaaccaagaggaaaagaagggaaacaagaaagagatggagacccatcattgtggccaacgaccccacgaagagggaatagcggtccacgcacgggacccagcctccgatcaagcccagcaggcgccgggtgcgcctgtgctgggaggcagagcccacgcccacccggaaccgcgccggccagcgaggtccgtgcgcagccccggctgccgcctgcgcttctccctccacacctcaccgttagcagagggagccggctccggcctcagccagccccagagacaggcccccacagcacagcggcgggctgaagggctcctcgagcgtggccagagcagacgccgaggctaaggaggtgccgagagacagcgagggctgctagcacattgtcacctctcaatactggaactcagaataagaggtctccactgttctgagttatgggagaaagatgggtgtatggtagacagaatagtgcctccccacaacaaagatgtcaacatgttactgtgtgtgttaaaagggactttgtaggtgtgagtaagttgaagatcttgagaagaaaagattatcctgggttttttgggtggggccaatgtcataaaaaggtccagataagaaagaggcagaagagtcagggtcagaggaggagccatcatgataggagcagagaagcagagtcaggagagttgatgctacactgctaactttgaagatgaagaagccacgagctatggaatggagacagcctctgaaaggcaaggagatggatttcctttagagcttccaggaaggagtgcaggcctgctaacagatacgttt

SEQ ID NO: 1110 - DNA, 103 bp, Homo sapiens
ctccgacgcggagctgcagatcgagcggcgcttcgtgcccgacgagtgcccgcgcaccgtgcgcagcggcgacttcgtgcgctaccactacgtggggacgttc

SEQ ID NO: 1111 - DNA, 66 bp, Homo sapiens
ggaggttaaaggtgagcacttgtagaacatacagctggtgcgccatctcattgttgatggcccgct

SEQ ID NO: 1112 - DNA, 48 bp, Homo sapiens
taggcgcccggccattctatggccaccttgacgatgtccgcgggtggc

SEQ ID NO: 1113 - DNA, 56 bp, Homo sapiens
tgtcttctctttagggatggtgaggttggaaaaaggctcctgtaaccctcctccag

SEQ ID NO: 1114 - DNA, 87 bp, Homo sapiens
tgtctcaaagtcccgtccggcaggcttcctcttcttcctcctcatcctcctcttcttcagctttgagcgtgggccagttagtcagca

SEQ ID NO: 1115 - DNA, 204 bp, Homo sapiens
atctgtagggctcagcccacgggttgctgagatcatggagagcgatgggctgctgtgcaaggagcggatatagtccatgtagggattaatgtagggatgtggagggctgaagggagactcggaagcagcagtggggttccggtgtggggagatcctaatgaagggcaggtccggatacgtagggctactagataaggcggaagt

SEQ ID NO: 1116 - DNA, 87 bp, Homo sapiens
gctgcccctgtttgcctccccgtgcatggtgtggactgtgttgtcattcccagggcaggacattcctggggtaggtccgagccctgc

SEQ ID NO: 1117 - DNA, 25 bp, Homo sapiens
ggaaggcccctggtatggacactga

SEQ ID NO: 1118 - DNA, 47 bp, Homo sapiens
aggaggttgccagcgaggataacccgggagacgtgggcggcgctgca

SEQ ID NO: 1119 - DNA, 27 bp, Homo sapiens
tttctcgtctccatgggtgatgatgta

SEQ ID NO: 1120 - DNA, 66 bp, Homo sapiens
cgtaggcctcaaagtcaccgttgttgacggcctcgatgagctgctccgtggtcttaatgatctcct

SEQ ID NO: 1121 - DNA, 32 bp, Homo sapiens
cggacgggctcggcgtgcgctcggctgcgctc

SEQ ID NO: 1122 - DNA, 95 bp, Homo sapiens
aggagacagcgaaggtgggcacaaggcagaggctgagcatgaagagcccctcagggaggatggtcaggtactgctcataaaacacattggtgatc

SEQ ID NO: 1123 - DNA, 27 bp, Homo sapiens
ggaggccaggctcgtgccgttttgcag

SEQ ID NO: 1124 - DNA, 172 bp, Homo sapiens
gaattcgctcttgagcgcgcgccgcggcccgccgccctcctcggcgccagccgccagctgctcggggctgctagggcccagctgcgcgtagtgttctatgaagtcgcccagcgagtcgcggaactcggcggccaccgccatggacagcgtgaggcggctcttggaaccgccc

SEQ ID NO: 1125 - DNA, 85 bp, Homo sapiens
cagctctgatgaccggtcggcaccctcagagggggatgagtgggaccgcatgatctcggacatcagcagcgacattgaggcgctg

SEQ ID NO: 1126 - DNA, 124 bp, Homo sapiens
catcaccggcatccacaggcagttcttctccaactgcaccgtggacagggtccacttggaggaccccccagacgaggttctcatcccgctgatcgttatacccgtcgttctgactgtcgccatg

SEQ ID NO: 1127 - DNA, 24 bp, Homo sapiens
tgggggtgcgaggaatgccaggcg

SEQ ID NO: 1128 - DNA, 117 bp, Homo sapiens
caccctcacgtgacccatgcccatggtggggggctggtttctcccctcccctagggggttccggccctcatggtgggcagacttctgctggggcgatattggcttggggtctgcttg

SEQ ID NO: 1129 - DNA, 111 bp, Homo sapiens
tgatgcttggccttccgtgctggtccagcccgccccatccgccatctgggacttctgggaggcgacaacgccttcctgcggcagctgcagtagggtctccttcgccctcga

SEQ ID NO: 1130 - DNA, 112 bp, Homo sapiens
gaagccacgtgcaaggacacctgccccccactcatgctctacaaccccaccacgtaccagatggatgtgaaccccgagggcaaatacagctttggtgccacctgcgtgaaga

SEQ ID NO: 1131 - DNA, 77 bp, Homo sapiens
caggcttggcctgaaaacaggacggacctccatgcctttgagaacctagaaatcatacgcggcaggaccaagcaaca

SEQ ID NO: 1132 - DNA, 30 bp, Homo sapiens
ccagggcctccaccgaacgctctcttgaga

SEQ ID NO: 1133 - DNA, 183 bp, Homo sapiens
agggccgccggaaagccgaaggtgggtccgggaggcctgaacgcagggaagcctggggcctacaacggctgccaggagctgggcaggagctgggccgaacgtggttgtcgtgaggcaggagctgggcccgtggaggtggccgggagagctgggcctggagaggccgacgggaaccagttctgg

SEQ ID NO: 1134 - DNA, 54 bp, Homo sapiens
gggtcacaagggagatgtccgcccccagtcgtagcctcggacggtttctgagcg

SEQ ID NO: 1135 - DNA, 197 bp, Homo sapiens
acttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaat

SEQ ID NO: 1136 - DNA, 72 bp, Homo sapiens
tgtggacctggtactgaggagcaagactgtccagttctcctccacatctcccatcccagaatcaggatctgg

SEQ ID NO: 1137 - DNA, 193 bp, Homo sapiens
aaggcagtaagaacggaagcggtgaggggtgcagctgaagaccgccagggctgcaccccacttaatggctttcccctcatgccttgggggggtctccactgggtggaggaaggaagccagggtgggatggaaagccccctcttctgtggcaaccctgaagtcagcctcttggaactgagggttgacctcagca

SEQ ID NO: 1138 - DNA, 40 bp, Homo sapiens
aagaactcggggatgagaagtcaacatctgttgagtcctg

SEQ ID NO: 1139 - DNA, 27 bp, Homo sapiens
gcggagctcctgggttcggtccttcat

SEQ ID NO: 1140 - DNA, 30 bp, Homo sapiens
gcagtggtgccggctcagctcgttgcagcc

SEQ ID NO: 1141 - DNA, 25 bp, Homo sapiens
cccggctttggtgtcggagtcggag

SEQ ID NO: 1142 - DNA, 45 bp, Homo sapiens
gccgctgggctcggaggactcggagtcggagggcttggagttcca

SEQ ID NO: 1143 - DNA, 30 bp, Homo sapiens
caagctgttgcaattctaccccagcctgga

SEQ ID NO: 1144 - DNA, 45 bp, Homo sapiens
agcgagcccggctgctcgtggagagcgtgcggaaagagaaggtgg

SEQ ID NO: 1145 - DNA, 102 bp, Homo sapiens
ctattctggccgtggcagtttcaatagcagctgaagtggccgccatctccttgtccaccaggtcccccagctcctcctgcttgatgtccagtcccctgggca

SEQ ID NO: 1146 - DNA, 106 bp, Homo sapiens
tcatcgtgttctacggctcccagacggggactgcagaggagtttgccaaccgcctgtccaaggacgcccaccgctacgggatgcgaggcatgtcagcggaccctga

SEQ ID NO: 1147 - DNA, 1445 bp, Homo sapiens
gcgggccacgttcacagatagacagattcacccgaaatgagaatgagggccttaaggctgccgaaaacaaatgggtggaaatagcaacgttgtttccgtcaattccaaatgtgcactggctgcgtgagacaagccaatctccaattcctatgcttttttcattaaaaagaaaaaactatctcgagaggaaaaagttctggtcaaataggagttcagtgtttgttatctggtaacagtttttttatcttcctacaattacttggggaaggagtgtcttcggggaggaaaaactgacacactgacaaggctcccgaaattggacagaatggttaaggatatagctcttccttttgggtttttctaccagtaggcttctagcacctgaattttcacacactgcaccacagaccttctccaaacgcctctccgaccccacagcttctgcacccagctgcgtccgccagcacgaggcgcagtaggaaacgccccagtgcagagtgggtgacggcagtgtgatccctgaggagggagctgcagcagcttcagaagcgggatgttctctgaaaataccaacacgatccatgacatacagacctgaattttctctatttttgtggcgtttcacgtttctctcaagaggattaataattttggtggtggatttacgttaagaggaaagaaggaccaaaaaaaaaaaatcccacagccacctgacctgaagtcgctttcattctcatttagcctaggagaccgatcaacagcaaaaccaacctggataaggctgaataaggatgttaaagcccaaacaactagcaaaggaaaagtacacaatcgatggcttgatgttacatatggctgtaatgtagaaatactgtaaactgcaatttagtgttaatactgtcaactaatcagagacttcggaaaactggcaaggcctaaaccataaggatgaatgagacctcaggttctaagtctgtcagtctgggatttacactgttccatgtctgtaggctacaccctggaaaacatgcagagccgagacagatgagatagaaagtacccaaaacgagagacgagagcgtatgtacataaaaatccttactggaaccacagaacttactgaatgagggccattcctctttaagttttcttttcatctgaaaaccctattatctagcaataagttaaattagagacagacagctccacttgcatgaatctacagaacagtccagacgccagtgtgaggctgctattccaataccagcacagctagcctgactttccactagtggtattttggcaaaaatgtcaaagaggcgatcaaagacaggacaggtcgtgggtttctccctgggaaggtcatccctccctttccctcccccacccgacccccaactcatgggaaaaaaataaagactgcagtagtagcatccgcgtgcgct

SEQ ID NO: 1148 - DNA, 47 bp, Homo sapiens
gtggagccagccatcctgagacgtccgtacagcccgtactggtggag

SEQ ID NO: 1149 - DNA, 30 bp, Homo sapiens
accctgggggcagcctcacctagggctgca

SEQ ID NO: 1150 - DNA, 196 bp, Homo sapiens
agtccgacagagggtactgcctggtgtcgggggagtgctgcctgtagtccagtaggggaggctgcctgtagtccaagggtgggggctgctggtagtcccctcctgggggttgcctgtaatccagcgggggctgcctgtagtctgtgaatggaggctgtcggatgtctggtttcacatcttgccttgctttcacttc

SEQ ID NO: 1151 - DNA, 25 bp, Homo sapiens
ctcccccgaggattctgaagccaaa

SEQ ID NO: 1152 - DNA, 32 bp, Homo sapiens
tgctgtgtcgaggccgagcttttgtctttgat

SEQ ID NO: 1153 - DNA, 55 bp, Homo sapiens
tgtgtgccgagaagcagtaaatgattgtgatattcgtgaaacgtgctcaggaaat

SEQ ID NO: 1154 - DNA, 29 bp, Homo sapiens
cattacaaaatgtggtggcttgagtaaca

SEQ ID NO: 1155 - DNA, 24 bp, Homo sapiens
actgaggttagagccatctggaaa

SEQ ID NO: 1156 - DNA, 24 bp, Homo sapiens
atcaaatctctcatgacccgacag

SEQ ID NO: 1157 - DNA, 36 bp, Homo sapiens
ggctccaaaggagagagcggtaacaagggtgagccc

SEQ ID NO: 1158 - DNA, 82 bp, Homo sapiens
gttggggacccatataggactccatcactatatggtgtcctttggatatatcgaagccatccaggtcggtctgggtaaccca

SEQ ID NO: 1159 - DNA, 74 bp, Homo sapiens
atgtctccctcctcgaaatcagtgagcactcccagtgaagctggaagccaagactcaggcgatctggggccatt

SEQ ID NO: 1160 - DNA, 30 bp, Homo sapiens
acaaaatccttcatcgttttggacccatgg

SEQ ID NO: 1161 - DNA, 33 bp, Homo sapiens
aggtgctctccgtgagccggttcacctcctcgg

SEQ ID NO: 1162 - DNA, 191 bp, Homo sapiens
ggcgtctgtagtgaacctcgcacatcagggtttcgaagccgctgtgcctgaagtctttgatcttgacttggggactccacgaacctgcaattccctcctccagcagcagcaccggtgctatctgtgtaaggggctggttcctccatgaagcagctgagcggcctcccaggcccggagtcttcatacaccgt

SEQ ID NO: 1163 - DNA, 175 bp, Homo sapiens
ccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgt

SEQ ID NO: 1164 - DNA, 54 bp, Homo sapiens
gcgcctcgaactgacaccggaaccggaaatagcttgggctcgacttcttcctcc

SEQ ID NO: 1165 - DNA, 76 bp, Homo sapiens
tgaaaaagctaactccaaaacagaaattttctgaagatttagagtcatataagatatcagtggtaatgcaggaatc

SEQ ID NO: 1166 - DNA, 60 bp, Homo sapiens
cctcatgagggtagtcccagagaccaggcgatggcatctgcactattcacagcggattcc

SEQ ID NO: 1167 - DNA, 24 bp, Homo sapiens
tgttcatcttcacaatccgatggg

SEQ ID NO: 1168 - DNA, 57 bp, Homo sapiens
ctccaccaagtcccggacagcagggctgctggggctgctcttgcgggagaggggccg

SEQ ID NO: 1169 - DNA, 39 bp, Homo sapiens
tccagcgaggcgtccgctgccatgcgagagtctccgcac

SEQ ID NO: 1170 - DNA, 106 bp, Homo sapiens
gtgtgaaccagaaaggagccgctgtcctccaccaggcctcggaaggtggcctcagtctccctgatcagcctctgctctgtctcactggaacagcaggtgtactcct

SEQ ID NO: 1171 - DNA, 115 bp, Homo sapiens
cacaaccggcctcagggtcacacagggcaaacgacgctcagactcttggcacataagtctggagactgctgtgggggtggcagtggctgtcactgtgctcggaatcatgattttg

SEQ ID NO: 1172 - DNA, 112 bp, Homo sapiens
ggaggcttcaaacatccggccttcaagaggcgcaggcgggtgaattcggactgtgactctgtgttaccctccaacttcctcctggggggcaatatctttgatcccctgaacc

SEQ ID NO: 1173 - DNA, 29 bp, Homo sapiens
ttgccaagcccgtctaacccatcggaaga

SEQ ID NO: 1174 - DNA, 211 bp, Homo sapiens
ccgcgagcgtgacgggaagctgctggaggtgatcgagcgcaagcgctgcgtgtgcaaggagatcaaggcgcgccaccgcccggaccgaggcctctgcaagcaggagagcatgcccatcctccccagctggcggcggggacccgagccccgcaagtccggcaccccgccctgccgccggcagcacacggtcctctgggacaccgccatctga

SEQ ID NO: 1175 - DNA, 29 bp, Homo sapiens
cccgagcgcaggacggtaccgccgtgtcc

SEQ ID NO: 1176 - DNA, 357 bp, Homo sapiens
cgaacccctacaaatatagatcctctctacaaaatagagataatttagcccccccatagcagctgttggggggggaaggggagggcacaggaggaagggggagactccagctcctgccacccctcacggggtacagagggcaggggcagggccggcggggacatgaaggcaccgtcagcactgagaggtggggactcgtggggctactggagggaggccagaggctgggggcccagggtctgggggcaccagagtggggcctctgaggtcagtgtctgtgaagggggtgcactagtgtctttggttggggctgaaggcaccgcaggtggggtcgggtggagcagggaccttataaat

SEQ ID NO: 1177 - DNA, 119 bp, Homo sapiens
ttcttgctgacggggattgtgtctgtggccttcctgctgctcccactcccggacgaactcggcagccagctgcctcaagtcctgcacgtctccctgggacaaaagttggtggccgccta

SEQ ID NO: 1178 - DNA, 137 bp, Homo sapiens
tggggggtttgagcgcctggagctgctgcaggaatgccgtgagctgctgctgctgctgctgtggcggcggcggtggtggcggtgtcaggtcccccagagctgccttttctcggagcgcgcactgtgggagctggcgg

SEQ ID NO: 1179 - DNA, 104 bp, Homo sapiens
gactttgaagacaacgcccatcccttctgtgactgggtccagacttccggggatggtggacactgggccctcggacataaaaatggacccgtccatggcatggg

SEQ ID NO: 1180 - DNA, 81 bp, Homo sapiens
cggccccacgagcttcacagctgagaagtggtcctggagctgcggccaggagtcagcgatgtggggttcatggaagacctc

SEQ ID NO: 1181 - DNA, 159 bp, Homo sapiens
agaattgaggaagcgcttccccgtgcccacctcagggtactgctccgccagcccccactcgggccagcagaagctctctgcagagaagagcaggcggctgccactctggacgaacttcttcagcagctctgtggggctgccggccagaatcacgtcgta

SEQ ID NO: 1182 - DNA, 136 bp, Homo sapiens
ggccgagggccctaactacctgacggcctgtgcgggacccccatcgcggccccagcgccccttctgtgctgtctgtggcttcccatccccctacacctgtgtcagctgcggtgcccggtactgcactgtgcgctgt

SEQ ID NO: 1183 - DNA, 42 bp, Homo sapiens
cctcctcactgaagcggtctgcctgggtcataagtttttctt

SEQ ID NO: 1184 - DNA, 35 bp, Homo sapiens
tccactccgtgacatcgctccaggacccgctgcag

SEQ ID NO: 1185 - DNA, 113 bp, Homo sapiens
agcgcttatttggggagaccatcttagggctcacccaaggctctgtctctgacctccttgcccgccccaaaccctggcataagctcagtctgaaaggacgagagcccttcgtc

SEQ ID NO: 1186 - DNA, 24 bp, Homo sapiens
gccgctgagcaccgcctggagaag

SEQ ID NO: 1187 - DNA, 81 bp, Homo sapiens
cagccgcctcctcggtgcgaccaccgaggcccaagaaagagccgcagacgctcgtcatccccaagaatgcggcggaggagc

SEQ ID NO: 1188 - DNA, 39 bp, Homo sapiens
gctctgaaagtggtgacgaaaggaagaacctcgaggaga

SEQ ID NO: 1189 - DNA, 24 bp, Homo sapiens
ctcagtaactgcaggaggacaatt

SEQ ID NO: 1190 - DNA, 24 bp, Homo sapiens
cggaaccggccggcgcgcctggcc

SEQ ID NO: 1191 - DNA, 118 bp, Homo sapiens
ccgccaccacacggagcagacgcgcgccgggagccgcgggccgggccagccgggccgccggggcccagtgcgccgcgctcgcagccggtagcgcgccagcgccgtaggcgctcgctcg

SEQ ID NO: 1192 - DNA, 24 bp, Homo sapiens
ccgcggacgcaggggcgttcaatg

SEQ ID NO: 1193 - DNA, 128 bp, Homo sapiens
cggaagttcgacggcgccgggcgagtggctgttgagcggcgccgcgggagttccgcaggtttcccgtgttcgcagcggagccggaggccagctgaacccggccgtgggatcccggataggaggaggag

SEQ ID NO: 1194 - DNA, 40 bp, Homo sapiens
ttcactgcatattctccccacagatagaagagcccagcca

SEQ ID NO: 1195 - DNA, 94 bp, Homo sapiens
cacacttggtcatccgggtgacatgggaggtgtcgtagcctctcccacagcacatgacttcacagctgtccatgccccgggaagtcaggttgca

SEQ ID NO: 1196 - DNA, 113 bp, Homo sapiens
gaggcacctggtctacaggatgaggcactaacggggtttatggaagagcaaaaggcaatggtggtaggaatgacaagggaactgtctgaacatgcaggttggttcagtccggg

SEQ ID NO: 1197 - DNA, 24 bp, Homo sapiens
ggtctcattactcatagcaggagc

SEQ ID NO: 1198 - DNA, 45 bp, Homo sapiens
tagcagaagcagtagccgcgacatgcgggcgagaagcgcgcccgg

SEQ ID NO: 1199 - DNA, 28 bp, Homo sapiens
ttaagttgattcaggggtgtatatatat

SEQ ID NO: 1200 - DNA, 24 bp, Homo sapiens
gggaagttctctctgggaacatct

SEQ ID NO: 1201 - DNA, 76 bp, Homo sapiens
agtttccaccccattgacaggcttggagtcttgagtaccatctgggtgggtggagctggcactggcacgaaacctc

SEQ ID NO: 1202 - DNA, 31 bp, Homo sapiens
tcctggaggatgaacggctagccagcgccca

SEQ ID NO: 1203 - DNA, 96 bp, Homo sapiens
ggcacatgccttgggctcgcagctcacgctgccctcccagcaaaggcagaggtggcaggcagcagtgggcgatgggaagcgctccccgctggcaaa

SEQ ID NO: 1204 - DNA, 94 bp, Homo sapiens
ccgaaggcgtggatgaagccgatccggccaagtggaaggccaacctgcgctgtgcccttaacaagagccgggacttccgcctcatctacgacgg

SEQ ID NO: 1205 - DNA, 76 bp, Homo sapiens
gatcgtggtgggtgtcctcatgttcctgctcaccttctgtggctgcattgggtccctccgcgagaacatctgcctc

SEQ ID NO: 1206 - DNA, 44 bp, Homo sapiens
gggcccggattctctgggcgcacaggtcgcctgagccgcctccg

SEQ ID NO: 1207 - DNA, 25 bp, Homo sapiens
ccctcttccggggcaatcccctcat

SEQ ID NO: 1208 - DNA, 94 bp, Homo sapiens
tcctgttggacaaagagaatgaagaaatgctttttaataggagaagagaacggagtggtaacttcaattttggggcctaccataccctggaaga

SEQ ID NO: 1209 - DNA, 24 bp, Homo sapiens
ggcggccgctacggtgctgacaag

SEQ ID NO: 1210 - DNA, 65 bp, Homo sapiens
tacacagacagcacgaggcagcccggcaagctctaatgggaaggatacgccctgatcacacactc

SEQ ID NO: 1211 - DNA, 71 bp, Homo sapiens
atttgcgtagggtcacgacgagcgtgacggtgagggaggcgcattctgtggtgaggataaacacaccccgg

SEQ ID NO: 1212 - DNA, 25 bp, Homo sapiens
tgaagaaaacagcaatccccatgac

SEQ ID NO: 1213 - DNA, 159 bp, Homo sapiens
tctggtgctgtaggccagtcactggatgtctgtggggagctggggaaaggaggaagcccacttgggatagggttgggatggcgaaaattgtctgagaataacgactgtgactctgttactgccccttcaaaaggggaccgtgcactgtgattggatgaa

SEQ ID NO: 1214 - DNA, 163 bp, Homo sapiens
gctggtctcattcgagataatgaaatggggaagatccacatccggcctggactccagccctgacaccctgagcagggaggaacctctatcccagccccccagctccccagccgagcccgggctggatgactcctctgggggagaatgttcctcgtagatcagc

SEQ ID NO: 1215 - DNA, 101 bp, Homo sapiens
agtcattcgttgcccagtttgcagccaagaatgtgcagagagacacatcatagataacttttttgtgaaggacactactgaggttcccagcagtacagtag

SEQ ID NO: 1216 - DNA, 56 bp, Homo sapiens
ggaagttctgcacggtgctctgtttctgggagagccggaggagctcctcgcggatt

SEQ ID NO: 1217 - DNA, 57 bp, Homo sapiens
attggctggcttggtgacagaagaaggagtggagaggcgtcggatgggaaaggaatc

SEQ ID NO: 1218 - DNA, 26 bp, Homo sapiens
actccaaaaccgcctcctcttccact

SEQ ID NO: 1219 - DNA, 25 bp, Homo sapiens
gcatcgcagacatcgatctcgctcc

SEQ ID NO: 1220 - DNA, 259 bp, Homo sapiens
cttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgcca

SEQ ID NO: 1221 - DNA, 76 bp, Homo sapiens
tgtccgctctgactcggctggcgtctttcgctcgcgttggaggccgccttttcagaagcggctgcgcacggactgc

SEQ ID NO: 1222 - DNA, 70 bp, Homo sapiens
tcctttctcgctgaggtcctggagatttctgtaaggctttcacgttagttagtgagccaggtaatgaggc

SEQ ID NO: 1223 - DNA, 27 bp, Homo sapiens
aaagaactggaataaccccttgcagaa

SEQ ID NO: 1224 - DNA, 26 bp, Homo sapiens
acaatggagaggaaaccaaccaccca

SEQ ID NO: 1225 - DNA, 27 bp, Homo sapiens
gggcagagctcgccccacaaagaagaa

SEQ ID NO: 1226 - DNA, 74 bp, Homo sapiens
gcgccgtgtcgcacgcagctccaggcggggcagccccggtagctgagggacgcagctagaccttggcgggacgg

SEQ ID NO: 1227 - DNA, 72 bp, Homo sapiens
catcagctcgtctgaacctcttgagctgtctcagtcgcatgtactctgattttacacgcttccgccaacaaa

SEQ ID NO: 1228 - DNA, 489 bp, Homo sapiens
ggaccctggatcatgcccctttgcccccagcccttggtttgcagggaggccgcctggcgatgcccagcctgaaacagcacccctggcagggctgctcagtggcagctctcactttgtgctcaacaggaagcaatcagaaacacataccagaagccaaatctacgccaacaatttctcagacaacgaaaaagcaaagagcaaaatcaacatgatttggaaaaggaattttaaaccttaaattaaaaaaagaaaacattttcacacagaagaattatctgctttgagaaataaagaaattagaaggtgtaaaaaaaaatttttcaaaccccaaataatgataaaaatagatgtatcctctgtaaaaatctggactaaactattcagtcattcatggttattcagtattcagagcatgaagtgaaacaccaaagtataaaaaattaaaaaaaaaaaaaaaggaatccgagatactgtcgtttgttgccggcc

SEQ ID NO: 1229 - DNA, 29 bp, Homo sapiens
cggcccggcagacgaaggcccgtgaggct

SEQ ID NO: 1230 - DNA, 32 bp, Homo sapiens
cccgcggcccagataaagtcgtcgccgctgct

SEQ ID NO: 1231 - DNA, 67 bp, Homo sapiens
ctgtattcaccctggactgtgccaaccagtgcccacacagctgtgccgacctctgggaccgcgttca

SEQ ID NO: 1232 - DNA, 24 bp, Homo sapiens
cacctccaaagtcaaggcccggga

SEQ ID NO: 1233 - DNA, 35 bp, Homo sapiens
ggcccggtggagatgccgtcgaccgccccttccag

SEQ ID NO: 1234 - DNA, 35 bp, Homo sapiens
gaagagggtcgctctccggccattctcccctcacc

SEQ ID NO: 1235 - DNA, 24 bp, Homo sapiens
tcttgttgtactcggccccagagg

SEQ ID NO: 1236 - DNA, 121 bp, Homo sapiens
cccagaaggtagtggccttgcgaaagaagcagcaactggccatcgggccctgcaagtcactgcccaactcgcccagccactcggccgtgtccgccgcctccatcccggccgtgcacatcaa

SEQ ID NO: 1237 - DNA, 42 bp, Homo sapiens
cagggatgggcacttcacgcttcccaatagcagagagcagca

SEQ ID NO: 1238 - DNA, 79 bp, Homo sapiens
gaaaggcagccgttgccttccgtcaggagccctatgtctcagttcaatatatgcttggcccagtatgttgtgctgctga

SEQ ID NO: 1239 - DNA, 60 bp, Homo sapiens
aggactatgaagagtacgggcccagcatctgccgccacaaccccgtctttggagtcatgt

SEQ ID NO: 1240 - DNA, 29 bp, Homo sapiens
agcgcttcggggaaatccgtgcagcagca

SEQ ID NO: 1241 - DNA, 85 bp, Homo sapiens
cctggacaggctcgaatccagtgaaaagcacaaaaggggtcaattctggagttagctttttagtgggaggtggtacgtcttcaat

SEQ ID NO: 1242 - DNA, 32 bp, Homo sapiens
ggtttttaatggtcccgtggatcattttgatg

SEQ ID NO: 1243 - DNA, 71 bp, Homo sapiens
tggaaacggccacagattctgacacggagagccgcggtctgcgggaataccactctgtcggggtgcaagtg

SEQ ID NO: 1244 - DNA, 104 bp, Homo sapiens
gcccgacagacaacgccaggaagcccggaggcgcctcatggccgccaagcgagcggcgtccttccggcagaattccgcctccgagcgcgcggacagcatcgaga

SEQ ID NO: 1245 - DNA, 84 bp, Homo sapiens
taacccgtttaaaggagcactatgagaaaaagatgagagatttgatggcaagcacggtgggcgtggtggagattcagcagctca

SEQ ID NO: 1246 - DNA, 163 bp, Homo sapiens
agacaggtttgctcggattccacctgccgtctttggtacagcgaatagtggcggatgtgactgcttccatgacatagcctgggttacactgatagctcacagtcttgttgaaggtgaagtcggtcccaaactggatgccatttgctagtgtgcctggatcccc

SEQ ID NO: 1247 - DNA, 121 bp, Homo sapiens
agacatcgagtttcgctgccgctccagagcccatttgccaagcactctctgacatgagaccccacaagcgtgtagccggtgttgcacgtaaatatagctgtggccccataaactgtcaacg

SEQ ID NO: 1248 - DNA, 164 bp, Homo sapiens
atggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactcc

SEQ ID NO: 1249 - DNA, 24 bp, Homo sapiens
ctgacgatatcagagctttgctga

SEQ ID NO: 1250 - DNA, 112 bp, Homo sapiens
ggctgaggcgtgtccctggcctcttcccccaggctggcagccccagattttgagcaggagtcggatgtgtggggaggtatgggggccggcgagcatgtcctggaccccgcgt

SEQ ID NO: 1251 - DNA, 274 bp, Homo sapiens
gctatagcttcatcgatgctctgaaagccttccagcttgccagtggacaggggtctggcaccttggctggcactcctggcagaaggggggtgctgcccagcctctctcagggggagcaagggctcctgccccccacgctccccctcctccaagctcgcctgtggctccgcagccggcctcgggaagggccaggtatgctcctccagcctggcctgccattccaggtaggagggcctgcgggtctccagcctcagtttctcggtgagggccttca

SEQ ID NO: 1252 - DNA, 29 bp, Homo sapiens
tcatcgccatctgtcccaccggacacccc

SEQ ID NO: 1253 - DNA, 24 bp, Homo sapiens
tgctgattctctgctgtcaaactc

SEQ ID NO: 1254 - DNA, 69 bp, Homo sapiens
cacgaggggatcatccacagcctggtcctgcgcaaccttgagggccgcccttacgtggcctggggctca

SEQ ID NO: 1255 - DNA, 84 bp, Homo sapiens
ggccgctggacttggccgactacacctatgacctggcggaggaggacgactcggagcccctcaactacaaagacccctgcaagg

SEQ ID NO: 1256 - DNA, 32 bp, Homo sapiens
gcccgccagcgctactccgcacctgccaccct

SEQ ID NO: 1257 - DNA, 80 bp, Homo sapiens
caagaaacgcaaacagcgggctggtggagagccctggggtgctaagaagccaaggcatgacctgcctccttaccgggtcc

SEQ ID NO: 1258 - DNA, 125 bp, Homo sapiens
ccataaccgtttctcagccactgaagtaaccaataagacgctggcggcagagatgcaggagctgcgagtccggctggcggaggccgaggagaccgcccggacggcggagcgacagaagagccagc

SEQ ID NO: 1259 - DNA, 80 bp, Homo sapiens
ggccgactggtgtctccaccacatctgcaccaactacaacaacgtgtgccgcaagttcccccgagacatgaaggccatgt

SEQ ID NO: 1260 - DNA, 713 bp, Homo sapiens
gcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaaca

SEQ ID NO: 1261 - DNA, 25 bp, Homo sapiens
ctgtccacacgctcagggtccccac

SEQ ID NO: 1262 - DNA, 71 bp, Homo sapiens
cgatgaagacgacgaacttaaggatcttggggtccaggagccatggtctggttcccgacgctgtcctggct

SEQ ID NO: 1263 - DNA, 37 bp, Homo sapiens
tgtaaagaagaagcccgccgggcatgccgagcaggaa

SEQ ID NO: 1264 - DNA, 80 bp, Homo sapiens
aagccaaacatgccgcagaccacgcgggaattcttggccgtccagtgcttgtcacagatctgcttccaggtcttgccctc

SEQ ID NO: 1265 - DNA, 386 bp, Homo sapiens
aatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccaga

SEQ ID NO: 1266 - DNA, 41 bp, Homo sapiens
tcgttggtggcatcttccgccgccaggcgcaggtcgcggat

SEQ ID NO: 1267 - DNA, 43 bp, Homo sapiens
tctggaggtcactctgacccctgaagtagagctccggaaagcc

SEQ ID NO: 1268 - DNA, 59 bp, Homo sapiens
tttgaagaaaagtgcggactgggtatcagactggtccagtagacccgaaaacattccac

SEQ ID NO: 1269 - DNA, 73 bp, Homo sapiens
aagtactgagtgtgatccgggatattggcgccatagcccaagtccacgcagaaaatggcgacatcattgcaga

SEQ ID NO: 1270 - DNA, 88 bp, Homo sapiens
gtatgaattctgttggcgggtgctggaaggccgggctatggaagtggatgtccatggcctgctgagcctcgtgtatcatctcaaggaa

SEQ ID NO: 1271 - DNA, 30 bp, Homo sapiens
ttcattaggtacacatttaccccagtacca

SEQ ID NO: 1272 - DNA, 24 bp, Homo sapiens
cctggtggacctgattctgatttt

SEQ ID NO: 1273 - DNA, 43 bp, Homo sapiens
ggaaggggcgctcctcccagctgtaccggccactgcaacccat

SEQ ID NO: 1274 - DNA, 27 bp, Homo sapiens
ttgttgctgcctagactgtatgatgga

SEQ ID NO: 1275 - DNA, 74 bp, Homo sapiens
taggccagagccccctacattcttgcctccgcggccgcggccgccgccgcctccccttcgcctggctctttcca

SEQ ID NO: 1276 - DNA, 108 bp, Homo sapiens
gctgagcgcctttcccagggaggtggggggcgccggggcagggctgcaccccgtggtatacccctgcacggccttgctgctgctctgcctcttcgccaccatcatcac

SEQ ID NO: 1277 - DNA, 76 bp, Homo sapiens
agccttggcgccttctacatccctgtggctttgattctgctcatcacctggatctatttcctgtgcgccgggctac

SEQ ID NO: 1278 - DNA, 41 bp, Homo sapiens
tcctccggctggatgagtctctggaacggggggagcagctc

SEQ ID NO: 1279 - DNA, 46 bp, Homo sapiens
gcactgctgcactcatcgcactgatgccacggacactcccactttc

SEQ ID NO: 1280 - DNA, 134 bp, Homo sapiens
ttgcatgcacgtaatcaaaacgggcaaaagacatttcttcatcaagttttctggggttcggtttcaccctgctgacccctttccaagccaattaaactgaagcacagcaggtcaaacggacagccaccaaaatg

SEQ ID NO: 1281 - DNA, 29 bp, Homo sapiens
gagctgaattccggaagatccccacatcg

SEQ ID NO: 1282 - DNA, 118 bp, Homo sapiens
gcaccacttgggtgaaggtgttcttggcctcctgcacctgctcttcttggccttgctgcctccggtccctgtcggcctgggagctctcagcctcgggctgttctgtccacgtgtgctc

SEQ ID NO: 1283 - DNA, 87 bp, Homo sapiens
ccggcgccttgtctgcacactggaggtcctccattacagaggcccagcgcacatcgctggccccacaaacgttcaggggtacagcca

SEQ ID NO: 1284 - DNA, 24 bp, Homo sapiens
tggtttcataagagcctgagagag

SEQ ID NO: 1285 - DNA, 110 bp, Homo sapiens
tctcagtgtcgctgcgctcggttggattccctcgcttcttttgtagctttggccaacagttacagtgatggtggcctccctcgggggtgactagtgtgcccgttttgttg

SEQ ID NO: 1286 - DNA, 54 bp, Homo sapiens
gtttcccgaccagtccctgggcgccaactagagtatggactgaccaggtacctg

SEQ ID NO: 1287 - DNA, 53 bp, Homo sapiens
ggcacagttaggtcgtgccctgataagggggtacacaaggggaactccaggca

SEQ ID NO: 1288 - DNA, 25 bp, Homo sapiens
catagtcctggctcggctctgtcat

SEQ ID NO: 1289 - DNA, 24 bp, Homo sapiens
ccagtgcccaactcattctcatac

SEQ ID NO: 1290 - DNA, 47 bp, Homo sapiens
gccaactacctcaggaaccgggagtgaaactactggggttgccattt

SEQ ID NO: 1291 - DNA, 74 bp, Homo sapiens
gagtttgatttcttgcagtcctgagcgatggagcccgggggtgcctggttattgtccgctttctctctcagatg

SEQ ID NO: 1292 - DNA, 28 bp, Homo sapiens
aactgcctcattgggagccaggacttgt

SEQ ID NO: 1293 - DNA, 44 bp, Homo sapiens
cgagccggggttgcggcctcggcggagtggtggctactgctgct

SEQ ID NO: 1294 - DNA, 48 bp, Homo sapiens
ttgacaatattcaaagttcccttttttccggcagtcacctattactaa

SEQ ID NO: 1295 - DNA, 80 bp, Homo sapiens
catttggaactccccgtgaggaggtcgaggcgcacagggcaagcaggaagaggcgagggcacttgggggtcattatttga

SEQ ID NO: 1296 - DNA, 29 bp, Homo sapiens
actccagccggggtgacaagagcaaaact

SEQ ID NO: 1297 - DNA, 27 bp, Homo sapiens
ccctcaacaaggccggcgacagcagca

SEQ ID NO: 1298 - DNA, 85 bp, Homo sapiens
ccctcctgcaaaacggcccaactacgttaagcttggcactctggcacctttctgctgtccctgggagcagttaactcaagactgg

SEQ ID NO: 1299 - DNA, 117 bp, Homo sapiens
aacggagcgatcagagtaatgggagcaaatccataggctgcaaagttccccgtctctcccacggccatcagcaggacaccaccccaccacagcacactcttgaagtatggccttggg

SEQ ID NO: 1300 - DNA, 25 bp, Homo sapiens
aggggacgcggcggtactctggcgt

SEQ ID NO: 1301 - DNA, 88 bp, Homo sapiens
gggagggccccatgacctacctcaacaaaggacagttctatgccataacactcagcgagaccggagacaacaaatgcttccgacaccc

SEQ ID NO: 1302 - DNA, 71 bp, Homo sapiens
cgatcccgtcctgtccgaataactcgagtctgccggcgggaatctcgagctccagctgatgacctaccaga

SEQ ID NO: 1303 - DNA, 109 bp, Homo sapiens
gcgtcctcgtgtgggccttcagatgggaacttttaaagtatgtcttgccacatcctgggtggctacagatgtgactccttatccttgatgaatcaatctgaggagtgac

SEQ ID NO: 1304 - DNA, 41 bp, Homo sapiens
cccgctatcaggttctcataccggacgtggcggaataccgt

SEQ ID NO: 1305 - DNA, 87 bp, Homo sapiens
tcatcgtctggggagattatggccgcatggatcacaaatcttttatgggagtggcccagatacttttagatgaactagagctatcca

SEQ ID NO: 1306 - DNA, 76 bp, Homo sapiens
gcggcagcatggactacctgacgacgttcaccgagaagagtgggcgccttctgcggggcacggccaaccgcctgtt

SEQ ID NO: 1307 - DNA, 34 bp, Homo sapiens
ctgaattaggtgacttagatacctggcaggaaaa

SEQ ID NO: 1308 - DNA, 42 bp, Homo sapiens
gccacaaagttggggacacgccggaagctttggtcccgcgag

SEQ ID NO: 1309 - DNA, 120 bp, Homo sapiens
ctgtcacagcgagaatccttgtgcttttgccagtctttgccatgcttgcaggtggtgaggagcacaacgtcctccccgttatggacgtgatataaggcattcctggtgtctgatcctatc

SEQ ID NO: 1310 - DNA, 103 bp, Homo sapiens
ccttttgacttattatcacttccacatttttctggggagcagattgtacagagagagaaacagttagctaatgttcaagttttagctttggaagaatgcctaa

SEQ ID NO: 1311 - DNA, 78 bp, Homo sapiens
tgctgaggtcgctcacgaaactgccgctcttctcatccaggaagcgcttccagccgtcggccgtcttcacccagttct

SEQ ID NO: 1312 - DNA, 145 bp, Homo sapiens
agcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcct

SEQ ID NO: 1313 - DNA, 99 bp, Homo sapiens
aaaaaatgcagttgtatgagcaactgagtttcttttcatcttcaaattcatttgtgatggtgggaagatctaaggacaatccttccattgaagaagtag

SEQ ID NO: 1314 - DNA, 29 bp, Homo sapiens
atggggtacttgttaaggctcccagaaga

SEQ ID NO: 1315 - DNA, 123 bp, Homo sapiens
tctctaggaaatggcgggccacatggctgggtaagatattccggagcatgttctcattgtgttccctcagctccttcatctcattgatctcctctttggcctgtactcgccaaaggaagtcca

SEQ ID NO: 1316 - DNA, 128 bp, Homo sapiens
ctgggcttgttccgggaagcgaaaagaccaagatcaaataatagctggggtggagaaaaaaatagctcaagacacagttaatcgagaagaaaagaaatatgtacagaaccataaagaaccacctcgtt

SEQ ID NO: 1317 - DNA, 29 bp, Homo sapiens
tgaggccagtcaggacggactgggatgcg

SEQ ID NO: 1318 - DNA, 31 bp, Homo sapiens
tttcccgggaagccgatctctccaggcaaac

SEQ ID NO: 1319 - DNA, 26 bp, Homo sapiens
ccttgcaaaccaggaggtccatccct

SEQ ID NO: 1320 - DNA, 41 bp, Homo sapiens
aaggggaaaatctacgtgattgacgccgagaggaagaccgt

SEQ ID NO: 1321 - DNA, 98 bp, Homo sapiens
ccagccgctctcgggcgcggcgtgggggaggcggccctgcaggtgcgtacccggggtccgacacgtgcggggcttcctgcgagctgagtccccgctgc

SEQ ID NO: 1322 - DNA, 26 bp, Homo sapiens
gtcagcctgtcgaagaggtcgtcccg

SEQ ID NO: 1323 - DNA, 54 bp, Homo sapiens
agcctgcttgggccgctcctgctggcctccacaggccgtgagctgtcagtgtct

SEQ ID NO: 1324 - DNA, 269 bp, Homo sapiens
agcggaatgagtcctgcttggccaggccaggctcctccgggccctcgcgctctgggccgttgccgccgctgcccgggcctggcaccgggaccttggtggggaaggctgctgggacgcggaaggccgaggggagcaggtcgccggcaggtgcccggcccccgggagccagcacgtcgtcttcgtaagcctccgcttccatgggcgccggtaggccgtcgtcgcccccatcctcgccgtggcagccgctcaagtaggaggccaaacgccag

SEQ ID NO: 1325 - DNA, 62 bp, Homo sapiens
agcttgtcacccacacggactccagcccgggccgcagggccttcctcggacacccgagagat

SEQ ID NO: 1326 - DNA, 29 bp, Homo sapiens
aggcctgggtcccacggtacttgaggaag

SEQ ID NO: 1327 - DNA, 58 bp, Homo sapiens
cgaacgacgcggatgctgctgcgggcagcgtccagggtgtcgtagaaggcccgcacca

SEQ ID NO: 1328 - DNA, 29 bp, Homo sapiens
gggctcgtggtggagctggccgcaggctc

SEQ ID NO: 1329 - DNA, 106 bp, Homo sapiens
ccagagcctctcagcatggcgtttgcaggagcacccctccagacctccacccctatcggagccatgggcacacctgctcccaagacggccttctccttcaacactt

SEQ ID NO: 1330 - DNA, 27 bp, Homo sapiens
ccagaaccgggagacttaaggcatctt

SEQ ID NO: 1331 - DNA, 76 bp, Homo sapiens
ggcgagcgggctgtggctgggtgctggtgggcagacaccatcagagcacagtccgtgccctggtagcgcaggtgca

SEQ ID NO: 1332 - DNA, 110 bp, Homo sapiens
tctccaccgcggtagtgggggcgcccctgctcctcggagcccgctatgtcatggcagaggcacgggagaagaggaggatgcggctcgtggtggatggcatggggcgcttt

SEQ ID NO: 1333 - DNA, 103 bp, Homo sapiens
tctcaacccctggcgcccttccgtctccccaggcccctgtcctgcttccccaactacaggggtgcacgcagaggggtccccaacagtggtcccccatccccag

SEQ ID NO: 1334 - DNA, 332 bp, Homo sapiens
gctcgcgtgtccacgggtgcgggaggccccacggctcacgggccccaacccctcctcagccacagctgtcacttgggcctcctcactgtactctgttcccaaacccagcaggcctcctgggtgaacgaggtcctggctgcccagacagctgtgtgggaactgaagggtgggcccacacccacactctctcccgaggccaggaccccgccagaacgcaccctgtgctcatccccccgacaggagtccaggtggcctgggggcgtccccgcatgctgcccacccctcattcctagttaaaggggttcccttctgcccagcaagtcagagtgctg

SEQ ID NO: 1335 - DNA, 91 bp, Homo sapiens
cagcttcagtctgcgggagggagcggcctgaatcaccaaggcgatcatggccaagtaggtgtaggggggcttgtcatgtcgcaggtacctc

SEQ ID NO: 1336 - DNA, 109 bp, Homo sapiens
acagttaatgaggtctacaagctggtcatccccatcctagaagcgcatcgagaattccggaagctgacactcactcacagcaagctgcagagagccttcgacagcatcg

SEQ ID NO: 1337 - DNA, 24 bp, Homo sapiens
gcccctagatctgacagtgaagag

SEQ ID NO: 1338 - DNA, 24 bp, Homo sapiens
acatccacctcttctatatatcag

SEQ ID NO: 1339 - DNA, 71 bp, Homo sapiens
tggtggaggttgccaacttaccaaaatactagtggaacttgggctggtgcaactaatgtcttgaggaggag

SEQ ID NO: 1340 - DNA, 51 bp, Homo sapiens
aaatgcaagcttgagtgagtgccagggactccatcagaggcggccatcttg

SEQ ID NO: 1341 - DNA, 38 bp, Homo sapiens
tgggtagtttgtttgtgggtggctttacagctccatca

SEQ ID NO: 1342 - DNA, 32 bp, Homo sapiens
acccaggtgcgaatagtcaggtgccaggtgct

SEQ ID NO: 1343 - DNA, 158 bp, Homo sapiens
gagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcacc

SEQ ID NO: 1344 - DNA, 24 bp, Homo sapiens
ggagcgaggcgcggcctgcgagtc

SEQ ID NO: 1345 - DNA, 24 bp, Homo sapiens
tgggaccacgagaccatcgtctaa

SEQ ID NO: 1346 - DNA, 127 bp, Homo sapiens
ctcacttcgggcctccacagtctgcaccaggccttcacccagcacagcaaagtcctccaggattgcttcaacattgggcaccattactagctccccacctcgagacatcaccatgcgcccctttgtg

SEQ ID NO: 1347 - DNA, 71 bp, Homo sapiens
tgagttgagcctggtgcgcgcccgcgggagggtccggggcagcgggatgctcggcgccgactaaggcttgg

SEQ ID NO: 1348 - DNA, 30 bp, Homo sapiens
gaagccgcctcacgcacgatccggagccaa

SEQ ID NO: 1349 - DNA, 42 bp, Homo sapiens
agacgacctgggtcagcaccgctgcgacagccaggagcagcg

SEQ ID NO: 1350 - DNA, 29 bp, Homo sapiens
ctcaggtgtggcccggaagagcagctcga

SEQ ID NO: 1351 - DNA, 24 bp, Homo sapiens
tggattatgaggggcctcggtcac

SEQ ID NO: 1352 - DNA, 185 bp, Homo sapiens
accctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatg

SEQ ID NO: 1353 - DNA, 46 bp, Homo sapiens
aggcctcaggttaggaaggaggggcacaggttcttgttggcatgag

SEQ ID NO: 1354 - DNA, 94 bp, Homo sapiens
tgaggagagcaatgattctgtgaatttttggggaatttgtggcaggagggaggaatggggacataggttgggagccactgagtggacatttctt

SEQ ID NO: 1355 - DNA, 26 bp, Homo sapiens
cagaggtagccgagactggagcctag

SEQ ID NO: 1356 - DNA, 28 bp, Homo sapiens
tcaggatgtccggtttccccaggatgag

SEQ ID NO: 1357 - DNA, 44 bp, Homo sapiens
aaagctgtccaggaccagtgggactgaggaggtagtgaagcaga

SEQ ID NO: 1358 - DNA, 53 bp, Homo sapiens
gagaccggtgcgactcatgaaggtgttcgtcacccgcaggatacccgccgagg

SEQ ID NO: 1359 - DNA, 69 bp, Homo sapiens
aacatggggcaattccacgcagggtccatggagggagcagaaagcagccgcaatgaagagccacggtgg

SEQ ID NO: 1360 - DNA, 71 bp, Homo sapiens
ctccggcttgggagtcagatcttcgtaaaggaaatgacccgaacgggtctggcaactaaagatggcaacct

SEQ ID NO: 1361 - DNA, 38 bp, Homo sapiens
tgcaagctgaaatcacctttaagaagcccatgcctacc

SEQ ID NO: 1362 - DNA, 25 bp, Homo sapiens
cgtagtagcggaaggcattaatgat

SEQ ID NO: 1363 - DNA, 86 bp, Homo sapiens
tgaggacgttgctgcgaaggagacttttttcttatcccaccaaatactactttatggttcttgttttatccctaatcaccttctcc

SEQ ID NO: 1364 - DNA, 90 bp, Homo sapiens
catttcttcatccagcctagccctggcatcctccttcttggggttgcaccattcaagtacacaatcatatagtcttcagctaccatcaac

SEQ ID NO: 1365 - DNA, 375 bp, Homo sapiens
gatatttcgcaggccatgaatcccattgattcttgtgctcgtcatcacggaccaccaatcccatctgctttaccaccggaagattgcactgtgactcagtctaaatcaagtctcaccatcttgaagacttttccggaaatgttatctctaggtggctctggtgggtcatccacctctgccccaacaatcaaaggcattgaccattcacaccttgcatcttcagaattcacctggtggcagcctcatgccaaggactctttttcctctaattttgtgccatctgatttcatggaggagcttcttacccttcattcttctgaggcctttttaggggggcactctgtggccaacctcatagagcctgttaacatctca

SEQ ID NO: 1366 - DNA, 933 bp, Homo sapiens
agttaaccacgtgtgcagtccgcggcttctcagaaagaagagtacacactgttatgatctttctctccaggcatgccagcctgcatttcatagtttgattgaaattgtgccatccagtctgtctcttcacaaacaaatggaatattctgagctgccagcatttggaggcgcacagcttgcatctttttatgaagaaaaataaacactgtgtatcgtaacaaccaagtcatgatggataaaacatgcctgcgatcgagaaccacttgcacggcccacgccacagactcgaggcaggtggggaacggctggacagtgatggagaacaggctgcgggcggctggccgagagagatgagtgggagccgcgtgtggacgtgccatcaaggagaactctcttttctggttgcatccccgccattcctgaagaacacaggcacgtgttgtttactccattggtgacaattagtggtggcgtccggttccctttgtgcttccagtcattactcaaatgcttcaaacttgtcccatctcctggacatccttaggttgttttgtggactagaaagaatttcaaaccactcacatgtgatttgccaactcattcctttggacaactgcttttcatagccccaaagtcctggagcagtggtgctcagggtgtggtccctgggagcatcagcatcagcatcagcatccgtcagggaacttgggaaaaatgaaaatgcttaggcccagccccagagctgctaaagggggatgggcaaaggacaaagggcaaagagctcacgtcaagtgaatttacacccatttacacactttctagaagtttcatccagtgaggtctacttaggtctctttggccggaacggtgtcatatggccgctactcactgcaaggaagactagggaacagagcttttgagttgggcccgtta

SEQ ID NO: 1367 - DNA, 36 bp, Homo sapiens
cagccctggcaacgagagcgtctaccccgaactctg

SEQ ID NO: 1368 - DNA, 60 bp, Homo sapiens
ggtgcccaagatgcgaagcacatagcaaagctgttcaatatcgttcttgcccgggaaaag

SEQ ID NO: 1369 - DNA, 91 bp, Homo sapiens
tgtatcttataaaatacgatggatttgactgtgtttatggactagaacttaataaagatgaaagagtttctgcgcttgaagtcctccctga

SEQ ID NO: 1370 - DNA, 109 bp, Homo sapiens
tcagtctagtatcaagaaagccccctggaggaggcatcttgcttgggatgctgttgtagtatgggtggtctgagccatctccctcctcttccgtccatggctcatccag

SEQ ID NO: 1371 - DNA, 28 bp, Homo sapiens
ccctccgtgggctcgctgcatccgcccg

SEQ ID NO: 1372 - DNA, 31 bp, Homo sapiens
gccctgggcccagatcgccgggcccgctcgc

SEQ ID NO: 1373 - DNA, 280 bp, Homo sapiens
attagttactcaggatagagggcaaagagattatatacaaaaagtattttcaaggactatcttgttcttcctttataagaagttgaatttaatttttgaagtaattacttaggaagaaatgcagaggagttccacagaaaaagatggcaaccagaatgatattccgtcagccagatttttaaaattccttcactctgaaatttcttctttgtcagctaaaactgttttctgggtcagtttccttaggtgagccttgttcacattcagtatcaaaaccagc

SEQ ID NO: 1374 - DNA, 195 bp, Homo sapiens
tgatttagaaggagtaatggaatcacaagttcttttttgtgcagcctgttgctgtgttaagggtggtctctctattaccctcctgggccttgtactcatggccagagacccagtggaactctcatccttctgcacttttattatcttcttgggagggccatgaaagtcagagaactctcctcgccgtttcttact

SEQ ID NO: 1375 - DNA, 32 bp, Homo sapiens
gtaggacagagagcacccgcttggcaggcgca

SEQ ID NO: 1376 - DNA, 206 bp, Homo sapiens
tccatctccgcctcaggggcttctccaccccaagtctggctccattcctggccttctgttggtgacagaccccccccctaaggtgctcgtttgggggctcttcaggcagcacctcagcctggcacccccactcccctgcgcagcccccaggcctcaggaccccacccctctgaggcccaggggagccctgttcacgctggtttctc

SEQ ID NO: 1377 - DNA, 49 bp, Homo sapiens
tgtccggcgtggaaaggtacttctgcttctcgaagcgtttctccaggcc

SEQ ID NO: 1378 - DNA, 30 bp, Homo sapiens
ctcccggcaggaaaccttgcttacttctga

SEQ ID NO: 1379 - DNA, 51 bp, Homo sapiens
gaaggcaccgctgtagaaggcccaggccgggatcaggctcagaaagcccgc

SEQ ID NO: 1380 - DNA, 140 bp, Homo sapiens
caaagactattctgctgctcaggaattaatggaagatgagatgaaggaatattacagtaagaatcctaagatcacaccagtccaggctgtgaatgttgggcagttgctggccgtaaatgccgaggaggacgcctggttac

SEQ ID NO: 1381 - DNA, 28 bp, Homo sapiens
cattcccaagtgccggagtggtgtctag

SEQ ID NO: 1382 - DNA, 24 bp, Homo sapiens
tgactgccgagagcgggccgccgc

SEQ ID NO: 1383 - DNA, 83 bp, Homo sapiens
acccgtgcttcatcattgccgagatcggccagaaccaccagggcgacctggacgtagccaagcgcatgatccgcatggccaag

SEQ ID NO: 1384 - DNA, 124 bp, Homo sapiens
ggtgctggcgtcagaggccaagggctgctcctccctctgaggctccccactctgtggagaatcttcccctggaggttcatggcctgttccctgggcctgcttgttgccacggatgttgtgcatt

SEQ ID NO: 1385 - DNA, 26 bp, Homo sapiens
aacctggaatgcatggagccccagga

SEQ ID NO: 1386 - DNA, 30 bp, Homo sapiens
tggaggcggcggtcgctgctccgcgtcccc

SEQ ID NO: 1387 - DNA, 562 bp, Homo sapiens
gtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaactgcatgtcta

SEQ ID NO: 1388 - DNA, 36 bp, Homo sapiens
ggaggtggacaacgttggagcggattctcccctgtc

SEQ ID NO: 1389 - DNA, 190 bp, Homo sapiens
ggccaaccctccagaagctgggtttcccatggttcaattactagaagctcttttctcagaaggccaaacattcggaatatttagatgacactgtcccatctccccttgggaaaatcataaggtttcaagtggaggagcttgaagtagcagcaatacatgtaggagattcagtagtcggtgattccagtcc

SEQ ID NO: 1390 - DNA, 61 bp, Homo sapiens
ttcacgtaacttgcattaatataatcttcatttccctgcaataatacccgggtggtgtcat

SEQ ID NO: 1391 - DNA, 1139 bp, Homo sapiens
ctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgta

SEQ ID NO: 1392 - DNA, 170 bp, Homo sapiens
tgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcaca

SEQ ID NO: 1393 - DNA, 27 bp, Homo sapiens
tgggggcgccgctgctctctcccggct

SEQ ID NO: 1394 - DNA, 25 bp, Homo sapiens
tccatatcagctgtcttgatgcttc

SEQ ID NO: 1395 - DNA, 24 bp, Homo sapiens
ggccagtggcgagcagagccaggg

SEQ ID NO: 1396 - DNA, 110 bp, Homo sapiens
ctgaggtgggccagacattccacgcagaaggagtggcagcaatccagcattttgggggtatggaacgtgttgttgaaggggttccagcagacggggcactcagcctcaag

SEQ ID NO: 1397 - DNA, 31 bp, Homo sapiens
ctgcaaggtgtgctcggagcgccgctaccgc

SEQ ID NO: 1398 - DNA, 509 bp, Homo sapiens
cagaatcctttgctggccggaagagttcaccatattggtgaacctcagtatcatggcctttcaccatcttcctgttcccacgtggcaaccaagggagggaatgtggtctccctccctccctgatggccagcgccccctgccctccaaccacggccagccccacaaggtgaagggccccagggcagacacttggaggtaaacggaggtggcagtccgtagttgcctcagaccagggagcccagaggagaggctgagagagggcctgctacagctgccaagggtggttggggacccctgaaaaattagaaggggccccgcaaggtcagaccagctaaaagtccttacgtggtaagcatatgtacattgcaggcctgctgcttcctggaccaactcttccatggccctgggtgtcacccagtgtttctggagcctctgagtggtgcccgctgcctggcagcagcccctggaggtaggcacttcctggcatcatggcagatctggcatcctct

SEQ ID NO: 1399 - DNA, 24 bp, Homo sapiens
gggctctccgggaatccaggacct

SEQ ID NO: 1400 - DNA, 40 bp, Homo sapiens
aaaatcagggaagcaaggcgagaagggccgcactggagcc

SEQ ID NO: 1401 - DNA, 93 bp, Homo sapiens
catcctgggtcctaatgggccggcagtggggacaggagactgtgccattgccttttgggaccgccttaggggacagaacatggtattcgtggc

SEQ ID NO: 1402 - DNA, 101 bp, Homo sapiens
ccgtttgcgcctgccttcaagatttctgaagttgcttggtctcagcttcatctcagcaaactggattgagtgttcgtggcccttccagtggaaccagttaa

SEQ ID NO: 1403 - DNA, 149 bp, Homo sapiens
accccgcggatggtgatggtataatgagtggctgctttgagcccaggcaggtctgtggacctcagtcctcctgggacggtgaggttctgggctgcctctactgtgtcagcctcctgcacctgaatgaaaaagtactcataggccccttc

SEQ ID NO: 1404 - DNA, 59 bp, Homo sapiens
ctggacctgagctttaatcccctgaggcatttaggcagctatagcttcttcagtttccc

SEQ ID NO: 1405 - DNA, 24 bp, Homo sapiens
acccagcattggggttgatgccat

SEQ ID NO: 1406 - DNA, 24 bp, Homo sapiens
ggaacacgctgtcctcgcgcttcc

SEQ ID NO: 1407 - DNA, 26 bp, Homo sapiens
gttttcgaggcggtttctccactgtg

SEQ ID NO: 1408 - DNA, 119 bp, Homo sapiens
tggaaatcctccatctccccggcatggtcatgtgatggtggcagcagggacaaagctcttcatccacggaggcttggcgggggacagattctatgatgacctccactgcattgatataa

SEQ ID NO: 1409 - DNA, 54 bp, Homo sapiens
gctgatggagccatccaaagggctggaagattcagagtggaaaatggctcttca

SEQ ID NO: 1410 - DNA, 34 bp, Homo sapiens
tgaccttccatcagtgcccgtgtttgacagaact

SEQ ID NO: 1411 - DNA, 103 bp, Homo sapiens
accgcggtgcgctgaagctagagattccgaaagggggttcgggtagttcgctccggagaagtctgagaagggtggctccggtgatcccagccctagctgtttc

SEQ ID NO: 1412 - DNA, 110 bp, Homo sapiens
ggaccctcaggatgtgcgcctccttgtggccggccacgccttccaagtggcagccccggaccaaggctggagtacgcggccgccactcgagcgtgcggcccatgtcctgg

SEQ ID NO: 1413 - DNA, 63 bp, Homo sapiens
ctgagcgctctgcgtggaggtcctgggcgcgcaggtgccaccgcgccgtgtggtacagcccca

SEQ ID NO: 1414 - DNA, 62 bp, Homo sapiens
tgactactggatcaggacttttgttccaggttgccagcccggcgagttcacgctgggcaaca

SEQ ID NO: 1415 - DNA, 143 bp, Homo sapiens
tttgaggcgggttgagcgccgaggtagtgggggctgggagggtcgagccgtcaccttgctgggtgttttgtcctgggtgttgggctgggagggtgggcggccgctggaggtgaacagggctgtcaaagcgttccgggcgttga

SEQ ID NO: 1416 - DNA, 200 bp, Homo sapiens
ggcttgccggcttcggggaaggtgcggcaggcggtgctgcggcctggcacagcaggtttggggtgcgggaggcgggcggggtaggagcgcggcgggcggggccgggcggcgggcggggctggcggggcggccgggccatgcagggcgcagagccggctaaaccctgctgagacccggctccgtgcgtccaggggcggcta

SEQ ID NO: 1417 - DNA, 307 bp, Homo sapiens
gctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataa

SEQ ID NO: 1418 - DNA, 117 bp, Homo sapiens
aaacaaatgacctgcacggacatcaacaccctgacaaggcagaaggaacttctcctgcagaagctgagcacatttgaggagaccaaccgcaccctccgagacctcctgagggaacag

SEQ ID NO: 1419 - DNA, 24 bp, Homo sapiens
ctcccctgcaacaccaaatggaac

SEQ ID NO: 1420 - DNA, 166 bp, Homo sapiens
tgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaa

SEQ ID NO: 1421 - DNA, 50 bp, Homo sapiens
tgagctatgccctgcggcccgagacctgggccacaacacggctggagctg

SEQ ID NO: 1422 - DNA, 683 bp, Homo sapiens
gcccgccgagcactcttgatctgagctgacctgtgtgtgtgtgtgtgggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagctt

SEQ ID NO: 1423 - DNA, 24 bp, Homo sapiens
tttgccctcaccttgactccatag

SEQ ID NO: 1424 - DNA, 64 bp, Homo sapiens
tgggggcctgtcgtcaccctggaagactgccttgctgccttctttgccgctgatgagttaaagg

SEQ ID NO: 1425 - DNA, 73 bp, Homo sapiens
ggtccctccatggcactctgggtcctctcctcactctccagagaccctcacatgtccttttgaacatccaaag

SEQ ID NO: 1426 - DNA, 26 bp, Homo sapiens
agcccgaagttgtggaggagctgacc

SEQ ID NO: 1427 - DNA, 32 bp, Homo sapiens
acaatggagcccaaatggggtcctcctgagcc

SEQ ID NO: 1428 - DNA, 49 bp, Homo sapiens
agaagaccaagcaggcggagaggatgctgggaaacgcggcccctctttc

SEQ ID NO: 1429 - DNA, 24 bp, Homo sapiens
gtcgggcgagctcagcaacaggtt

SEQ ID NO: 1430 - DNA, 31 bp, Homo sapiens
tttcgatccctgggaccaaccgcatcctcag

SEQ ID NO: 1431 - DNA, 682 bp, Homo sapiens
gctggtttcgggtctaaatgcccatcctcacccttctcccaagacaaccgggaagaagggctcaagagactctcgcgggcgaccccaaccctccctccacctctggcagaagaggaaaagtccggtagaaaagagatcctgctttctttctccgattggttttcttcctttcaattcagcttaaggcaaaagtttggcaaagcaagtctacataaggccgcatgacagagggcggagggacctggggggaaggccggccagcgccacaaatcggcagcagtgtggatctgtctctttgatcgggggctggagcttccctcctaatcagctccccctcctcctgcccctgagcccccaaaagaggagtttttttaaaaaacggaaaaagcagtgtttcagggaatctgttacaagtgagcgactgaaactgagaaaaaggagaggcaaggagaccagaggtcaccctgagggcgcacgtggggtctgtctgtcctgcttagatctcccctctccctgaaaggaagcaggtgccgagagccggggaggccttcccgggggcatcagcacagtgagatccgcccgctggagagggtagaatggttgtatcttgctgaatgactgaagagtgagtctgagttttgttttcagcggtattattatttgtgagtctaacctagcgggt

SEQ ID NO: 1432 - DNA, 39 bp, Homo sapiens
ctggctaacactgacaggggtcgcttgttcctgtgcagt

SEQ ID NO: 1433 - DNA, 58 bp, Homo sapiens
ggcaggcagaactcctcgaaggccggcttcacgaaggtggtgtactgcgtcagaatct

SEQ ID NO: 1434 - DNA, 105 bp, Homo sapiens
aaatggaagcgacagacggccgtcgggttggagctgctggcggaggcaggcaattactcagcgctccagcggatgttcccgtcgccttatttctacccgcagagt

SEQ ID NO: 1435 - DNA, 24 bp, Homo sapiens
tccaaagtgggtccagtcgacaga

SEQ ID NO: 1436 - DNA, 85 bp, Homo sapiens
ccaaagtctcgcacatcgaagaggtcaaaggggtcaaacagctcgctgttccttaatccaaatttatcgtggcagactttcagga

SEQ ID NO: 1437 - DNA, 27 bp, Homo sapiens
aggcaaggatggactcccaggacaccc

SEQ ID NO: 1438 - DNA, 25 bp, Homo sapiens
tgccaggtcgttggaggtggcagcg

SEQ ID NO: 1439 - DNA, 47 bp, Homo sapiens
agaagacactgaacgagcttcccttgttttgcctggaagcccacgct

SEQ ID NO: 1440 - DNA, 154 bp, Homo sapiens
tgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtgg

SEQ ID NO: 1441 - DNA, 82 bp, Homo sapiens
atgatgtagaagatcactcggtagcctgtcatgaagtgcttatttgcggagtgtaggaacggcctcaggtactcctctgcaa

SEQ ID NO: 1442 - DNA, 145 bp, Homo sapiens
agtcgctgcacgactcttcccggtgcaccgacttcggccgcggcttcttcggctttgacttgggcttgccgagcccctgctcctctaggatctgctgctgcttcctccgcaggtactcctgcttgatgagctcgcgccgcgcctt

SEQ ID NO: 1443 - DNA, 94 bp, Homo sapiens
aagcatttagtgctcatcgccgtccctctgaggggggccgtcagaaaggcaactgggacctgacagacccgggcacatacttgaaattcctgaa

SEQ ID NO: 1444 - DNA, 214 bp, Homo sapiens
aggcacactcgtgggtgacgtcgcccgtggggcggcaggtgcccccgttctggcagggcgaggggctgcagggcacgtagggccgctcgcagttggggccagtgtgggtggcgcggcagacgcagcggtaggagccgacctcgttgtggcaggtgcctccgtggcggcaaagcccgggcttctggccacactcgttgacatcctgccggcaggt

SEQ ID NO: 1445 - DNA, 97 bp, Homo sapiens
tctgtgaatccacccctggctacccccaccctggctaccccaacggcatcccaaggccaggtgggccctcagctgagggaaggtacgagctccctgc

SEQ ID NO: 1446 - DNA, 25 bp, Homo sapiens
ctggggagaaggcttgactatttga

SEQ ID NO: 1447 - DNA, 26 bp, Homo sapiens
accctgggggtggcgactacgaggag

SEQ ID NO: 1448 - DNA, 110 bp, Homo sapiens
gtatctacctgaacggcgacggcaccgggcgaggaacacacctgtccctcttctttgtggtgatgaagggcccgaatgacgccctgctgcggtggcccttcaaccagaag

SEQ ID NO: 1449 - DNA, 135 bp, Homo sapiens
cttggagcaggacgcgaactggtacccggaatgggagaagctgaggtgcaggacctggtctgtgtgttcccgcagcgtctgcacctccacgcagggcaccgtgtcatacagccgctggaactcctcgtaccagga

SEQ ID NO: 1450 - DNA, 34 bp, Homo sapiens
ggcacctggtacatggtcggggtggtgtcagatg

SEQ ID NO: 1451 - DNA, 59 bp, Homo sapiens
cgagcgcccgagctgtttcccgaaggcgcccagaagatgcagctactggcgccccaagt

SEQ ID NO: 1452 - DNA, 93 bp, Homo sapiens
gtacccaatgagggcgatggccgtggagagcttccgcttgttgccgccgctgtaggtgccagccggcttgtctgcgtacttggtcagctccag

SEQ ID NO: 1453 - DNA, 127 bp, Homo sapiens
gcttgctccttgaggaccctgggcagggtggctgccatggggcccaatcgtgcgtgggaacctgcgagctggcaaacggggctcgggggttttgcccagaaatgggtcagaacgaaagcctctcaga

SEQ ID NO: 1454 - DNA, 30 bp, Homo sapiens
tccgcgctggagctcggttccagcgccgcg

SEQ ID NO: 1455 - DNA, 134 bp, Homo sapiens
acgtcatgaccagcgagttcactctggggcccacggccgagttcttcagggagcacaacttcttccacctggaccccgccaacgtggtcatgtttgagcagcgcctgctgcctgctgtgacctttgatggcaag

SEQ ID NO: 1456 - DNA, 31 bp, Homo sapiens
ccaggtggagcaagttggcaaacaggctcct

SEQ ID NO: 1457 - DNA, 56 bp, Homo sapiens
gagcacgctggtggcctccaccaggaggagaatgagtgccgtgaggcctgagaccc

SEQ ID NO: 1458 - DNA, 150 bp, Homo sapiens
gaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacat

SEQ ID NO: 1459 - DNA, 233 bp, Homo sapiens
gccgagaaggtcgcaggcagcggcagcgcgcaggatgcggaccgaggccggcggggacgtcgcgggggacccggggcccgcgggccggcggccgggcagcagctgcagaaggcccagcgccaagcggagcccgccgctgcccaggcagagcgcgtggaaggcccgcggctggaagctcagcacgagctgcgtggctgcgtcccgcgtggggcagcagaaggtccctaggcgcg

SEQ ID NO: 1460 - DNA, 25 bp, Homo sapiens
tcgccccccagaaactgacggacaa

SEQ ID NO: 1461 - DNA, 34 bp, Homo sapiens
tgggtccgctcacgaccgtcctgtttcttgctcc

SEQ ID NO: 1462 - DNA, 66 bp, Homo sapiens
cagcagcccgtgatcccccagcaaccaatgatgcccgttcctggccaacactccatgactccaatc

SEQ ID NO: 1463 - DNA, 30 bp, Homo sapiens
cgccgccggtgcgctccaagtgccccggcg

SEQ ID NO: 1464 - DNA, 33 bp, Homo sapiens
gcctcccgcgtcgctgtcgctgttgcctccgcc

SEQ ID NO: 1465 - DNA, 53 bp, Homo sapiens
tcttggccgaagcaatccgaaggacacacaatggggaatccgtgtcctacctg

SEQ ID NO: 1466 - DNA, 356 bp, Homo sapiens
tcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatgg

SEQ ID NO: 1467 - DNA, 72 bp, Homo sapiens
tgaaaacagttcttcttattcccagtctcattgttcctcccaaattgccagggttgtgctcgggcatatcaa

SEQ ID NO: 1468 - DNA, 36 bp, Homo sapiens
tccccaggtaatcaccacgcctctctttattgatca

SEQ ID NO: 1469 - DNA, 114 bp, Homo sapiens
ctccggctggcgtgcaatttaatttcgactttgatcagatgtaccccgtggccctggtcatgctccaggaggatgagctgctaagcaagatgagatttgccctcgttcctaaac

SEQ ID NO: 1470 - DNA, 108 bp, Homo sapiens
tggaagaattctatgcctggctcccaatcggtacaatcgttgacaatgaaatcctggtcatccatggtgggatatcagagaccacagacttgaatttactccaccgtg

SEQ ID NO: 1471 - DNA, 65 bp, Homo sapiens
gtgaggacggcaatgctgatgtcctgcccactggcctcgtagatgagttttgtgagctcctctgg

SEQ ID NO: 1472 - DNA, 111 bp, Homo sapiens
ggcggtggctgcacaccatcacctggaagaaccgagttgccggtggactccgggggtgctggatgtccgacggcgcagatgcggcgtcccgggagtgcagggcgaggactc

SEQ ID NO: 1473 - DNA, 51 bp, Homo sapiens
tcaatcagtagaaggcgggacaccgaagccatacagaaagccaaaatcctt

SEQ ID NO: 1474 - DNA, 67 bp, Homo sapiens
tctgactgataagccacccaagcttttgtatcctatggaaagtaaactgacaattcaggagacccag

SEQ ID NO: 1475 - DNA, 27 bp, Homo sapiens
caggtgtaccgtggcatctcgcactgc

SEQ ID NO: 1476 - DNA, 201 bp, Homo sapiens
cagaagggtctcgccagcgttcttattgacaataagtctccgtgcttccggcggcatagggcgagactgggtggtctcctgaggggaacttgagcatggcagctgtgtggactgggaggctggtagcagttgctgcaagcggtcgaagggctttggctcctgcttggctggtgacagatcatagtccgaactgggctccgg

SEQ ID NO: 1477 - DNA, 94 bp, Homo sapiens
gggcttggcgcaacggcacacgatgcggtcctcgagcctcccgggcgctcggtcaccgcgccgaaacgggagcgggcagagtcgccaccgccta

SEQ ID NO: 1478 - DNA, 31 bp, Homo sapiens
atgaacatgagtcgcctccacctgaagatgc

SEQ ID NO: 1479 - DNA, 29 bp, Homo sapiens
aagaaagatggcacttggcccagcgcaca

SEQ ID NO: 1480 - DNA, 24 bp, Homo sapiens
gcctctgacttgggaatttggtac

SEQ ID NO: 1481 - DNA, 31 bp, Homo sapiens
accatgggggagagtccccattagctgccat

SEQ ID NO: 1482 - DNA, 97 bp, Homo sapiens
atggcttccgttgccaaacctgtggctacaagttccaccagcattgttcctccaaggtccccacagtctgtgttgacatgagtaccaaccgccaaca

SEQ ID NO: 1483 - DNA, 90 bp, Homo sapiens
gcacatctgtggaccctcataaccctcttaagacccctctcagggtgccactgatgggggatgagggaaggccctctctctactccttga

SEQ ID NO: 1484 - DNA, 25 bp, Homo sapiens
gccgcccagctccgggaatggacca

SEQ ID NO: 1485 - DNA, 149 bp, Homo sapiens
tgagttacttgctgccctgtgctcctccccgcaggacatggctccccctccacctgctctgtgcccaccctccactctcctcttccaggcccccaaccccccatttcttccccaccaacccctccaatgctgttatccctgcctggtcc

SEQ ID NO: 1486 - DNA, 43 bp, Homo sapiens
atcgtagcggcgacacgagagagacgggcggtgtgacagcctt

SEQ ID NO: 1487 - DNA, 79 bp, Homo sapiens
cggagggtggcgacttgggtcctgcagatgcccaacaccctccaccccagtccccctcccttgtgtccccccattgctg

SEQ ID NO: 1488 - DNA, 35 bp, Homo sapiens
tccttttcccaggccggcgcgctgcttgctgggaa

SEQ ID NO: 1489 - DNA, 52 bp, Homo sapiens
cggggacgtcgtgctccacatcaacggagagtcaacgcagggcctcacccat

SEQ ID NO: 1490 - DNA, 89 bp, Homo sapiens
cagtgatggtcaccgggaagatgcgcacgatgccacgccccagattctcccgcttccgctgctggctaaaggctcggagctctttcttt

SEQ ID NO: 1491 - DNA, 172 bp, Homo sapiens
cctcctcatcgaagcgggagaggatggactcctcgtcgctatagagagagctggttccctgtgccagcaggtcactggcagcattgtccatctcatccagcgtcaggcgacacgcatctgcaatctcctgcttggccagggccacgaaacgtgggtctcgagcaaagaggcc

SEQ ID NO: 1492 - DNA, 67 bp, Homo sapiens
atgtgtcccggctggcctacacccagcgcatcctggagatcgtgggcaacatccggaagcagaagga

SEQ ID NO: 1493 - DNA, 56 bp, Homo sapiens
gaagatccgggaggactaccgagccctccgccaggagaacgctggcctcctaggcc

SEQ ID NO: 1494 - DNA, 74 bp, Homo sapiens
agcggatgagcgtggcgtaggtgaaagggggtcgcatgttgtggaacttgaagtagtccatgttgtggaggaac

SEQ ID NO: 1495 - DNA, 43 bp, Homo sapiens
ctttatcttctacattcagggtggacacatcgacaaagcatat

SEQ ID NO: 1496 - DNA, 260 bp, Homo sapiens
gataaactggagggcatcaactgggggaggttgtagtgtaggagtttgggtgagggggcccgagcccatctgtttggacttgagggaaagtggcttggggttagagtcgggggaggatcagaatgtcttgcccaaggttaagaagctggtggaacttgatttcagaacccagagctccctggcttcagccctagtgctcctgccagcactacagctgctccactgactggtgatggaagcactgtcttccccgtctaaga

SEQ ID NO: 1497 - DNA, 118 bp, Homo sapiens
gtggtgctgtggactgggaccgcagggcaagacccggtggcctggagcagcgcccaggctggtgtccgagggtccgacaaactggggatccagtgggccgccaagagccgaacctgag

SEQ ID NO: 1498 - DNA, 81 bp, Homo sapiens
ttccgaggctccagggtccgagtcggcacaggccggcggagcggcgcccggcgggttcgtggccgggtgttcgggctccga

SEQ ID NO: 1499 - DNA, 45 bp, Homo sapiens
aggcgaccacgatgccgtgggccgagagtggcaacgaccctttcc

SEQ ID NO: 1500 - DNA, 199 bp, Homo sapiens
ggccagaaactcataatccagaggaactgtgtccagcaggcgggcgtagttgccattgatctgggcgatgatctggtactcctgtcctatgcagggctcatcagagtagttgttgcccagattctgggaagttggctcatcactggagcagccacttgcgaagatggccaccctcatggtttctccagagtcgttggcc

SEQ ID NO: 1501 - DNA, 289 bp, Homo sapiens
acttcacacgtgtagtggctccggtcatccatctccagggtgctcaattggagggatacatctcctggaaccttgtggctcacatgcaggcggccctggtactttgcctgctggatatggtctccagaagagtcacgtagaaagatggtgacagggtctgagccacgttgtaccagccacttcaccaagacttgggtgtagccttgcagggggtcataggtgcagggaagattcacatcccctttccaaggtcctgttacactctctggcacttccaggatgggacggc

SEQ ID NO: 1502 - DNA, 472 bp, Homo sapiens
ggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggc

SEQ ID NO: 1503 - DNA, 40 bp, Homo sapiens
cctggatggatagctactccggaccttacggggacatgcg

SEQ ID NO: 1504 - DNA, 60 bp, Homo sapiens
gcagacattgcacccctataacacctttgccgcagggttcaacagtaccgggctgcccca

SEQ ID NO: 1505 - DNA, 28 bp, Homo sapiens
cagcagctaccatcactgctgccgccat

SEQ ID NO: 1506 - DNA, 125 bp, Homo sapiens
agcccatattctatggagtccggatgatcatcatcgccctcttggctgaccttctggagatgctgcagataagcatcagtgtggaaggtggccatctcctccatggaggccactttaggcttaac

SEQ ID NO: 1507 - DNA, 146 bp, Homo sapiens
tgtacccgggcactctcatgagccctgggggcgacggcacagctgggacaggcggcacagggggcggtgggagtccgatgccagcctccaatttcgctgcggcaccggctttctcgcactatatggggtatcctcatatgcccagc

SEQ ID NO: 1508 - DNA, 95 bp, Homo sapiens
ttggagagcagtgaacatgacgataacggagtaatttctcggtggggctttcacaaggcgacggaacttgtctccattcattcttattacaggtc

SEQ ID NO: 1509 - DNA, 91 bp, Homo sapiens
gccaaccgctgtttcagcccctagctggattccagccattgctgcagctgctccacagcccttttcaggacccaaacaaccgcagccgctg

SEQ ID NO: 1510 - DNA, 124 bp, Homo sapiens
tcccatatttctgcttcccctcacttttagaagttaattgatggctgacttctgaaagtcactttcctttgccctggtacttcaggccatatacatcttttcttgtctccataatcctcccttt

SEQ ID NO: 1511 - DNA, 85 bp, Homo sapiens
cgtggccgctggtgtggttatcggggctggtgcctgctactgtgtatacagactggcttggggaagagacgagaacgagaaaatc

SEQ ID NO: 1512 - DNA, 102 bp, Homo sapiens
ttgggtaccgctccagtcgctgatgtggctttcggtatagccccagtgtgagccccaggggttgctttcttggcagctgatgttccaggaaccaccgctgtt

SEQ ID NO: 1513 - DNA, 45 bp, Homo sapiens
gtaggtaggtgggtaggaggatcatgaaggctctagttttttctt

SEQ ID NO: 1514 - DNA, 24 bp, Homo sapiens
aattcaggcgtgctgcaagtctct

SEQ ID NO: 1515 - DNA, 28 bp, Homo sapiens
tgggcaatgaatcctcggtaataatcat

SEQ ID NO: 1516 - DNA, 66 bp, Homo sapiens
tgctgatggagttcggagtctctcctgtctcttgggggctcttgagggtctattccctgggcctcc

SEQ ID NO: 1517 - DNA, 85 bp, Homo sapiens
ttctaagcccctttgtagcgttcaaggaagaccagaaactggccacactatttccctttcctgtctctctgcgcttggaacacct

SEQ ID NO: 1518 - DNA, 25 bp, Homo sapiens
tgcgggatggtgatgtcctggctgt

SEQ ID NO: 1519 - DNA, 80 bp, Homo sapiens
ggccagctgctccaattgtggtacggcctgggtttccttggtcccccttcagccctggaaatccctgaggccctagggct

SEQ ID NO: 1520 - DNA, 60 bp, Homo sapiens
tggaaggtgggaggcgcgcccagggatgagcgagatgaggagggcgcgaaccagcaatct

SEQ ID NO: 1521 - DNA, 120 bp, Homo sapiens
ggcaacattgagtggcggacaacactttttggcatctctccaattcagctgttagcatctcctagtgtcttcttcacagctaacagctttggctacttgctcatgacactccgtctctga

SEQ ID NO: 1522 - DNA, 24 bp, Homo sapiens
tcttatttgtccttcttagcagct

SEQ ID NO: 1523 - DNA, 41 bp, Homo sapiens
ttatcacttccaattccagagtcagggccatgatttttatt

SEQ ID NO: 1524 - DNA, 64 bp, Homo sapiens
ttatattccctccaattcctgatcctggcaagatttttaaagaaatgtttggagaccagaatga

SEQ ID NO: 1525 - DNA, 252 bp, Homo sapiens
catgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattc

SEQ ID NO: 1526 - DNA, 48 bp, Homo sapiens
tggctacgtggaggcgggacggccgactgacaggcggccaaaggctgc

SEQ ID NO: 1527 - DNA, 24 bp, Homo sapiens
tgatccaccgcctttcctggagaa

SEQ ID NO: 1528 - DNA, 130 bp, Homo sapiens
gtagacctagcctatgaaatagccaaacatgtaaggatcaaatacaaattgtccatcgttggtgacgggaaatatggtgcaagggatccagagactaaaatatggaacggcatggttggggaacttgtct

SEQ ID NO: 1529 - DNA, 25 bp, Homo sapiens
ttagtggtctccacccttgccatcc

SEQ ID NO: 1530 - DNA, 70 bp, Homo sapiens
tctgcctcgggcttcggacgcacacggtccgcaccaagggcaccagcttctgcttcaaagcacccgccgc

SEQ ID NO: 1531 - DNA, 105 bp, Homo sapiens
tctggcatcggtggttttacttcttcgattgaaccctgcttcctcgacccccctgggaggccgccttcttcaggcgcctcccttctctccacgagctcgctctga

SEQ ID NO: 1532 - DNA, 26 bp, Homo sapiens
taccaccgtacgaaagaagcctgatc

SEQ ID NO: 1533 - DNA, 32 bp, Homo sapiens
tgcagggataaatgccggctgtgggagctgca

SEQ ID NO: 1534 - DNA, 71 bp, Homo sapiens
cagcgtcgcctgaggacgtgcatccgcctgcggcggccccgggacagcagcgcgaaaagcggggcgcacgc

SEQ ID NO: 1535 - DNA, 25 bp, Homo sapiens
ggcctgatgacatgcccccttgtcc

SEQ ID NO: 1536 - DNA, 25 bp, Homo sapiens
tcttgcctctccggggatttgcttc

SEQ ID NO: 1537 - DNA, 74 bp, Homo sapiens
gtcacctggagatgacgtcctgggcggctctgccccttctatccagcagcagcactaatgtccggagacccaag

SEQ ID NO: 1538 - DNA, 25 bp, Homo sapiens
ggcccatgctgcgggagcctgtgtg

SEQ ID NO: 1539 - DNA, 49 bp, Homo sapiens
tggaggcagctagcgcgaggctggggagcgctgagccgcgcgtcgtgcc

SEQ ID NO: 1540 - DNA, 41 bp, Homo sapiens
tcttcaggcatgcagcgctgacgctttggagctcgaggcat

SEQ ID NO: 1541 - DNA, 25 bp, Homo sapiens
tgtcttgacgggatcactggggctc

SEQ ID NO: 1542 - DNA, 137 bp, Homo sapiens
cgtacccctgtggcgacgagcacacccccagccccattgctggccgccagcccctggaggtccagcctctgctgaagctcgggcagccggtcagcgccgtggcagctctccaggcagatgggcacatgatagccttc

SEQ ID NO: 1543 - DNA, 58 bp, Homo sapiens
cagctcaccatccgaggtcagcacctccagacaggtggcaacaccagtgccttcgtgg

SEQ ID NO: 1544 - DNA, 113 bp, Homo sapiens
agggcctcaacctgggcatcagcaaggaggaggtgcgcgtgcacatcggccgcggcgagtgcctggtgaagacgctcacgcgcacccacctgtactgcgagccgcctgcgcac

SEQ ID NO: 1545 - DNA, 255 bp, Homo sapiens
gacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcaca

SEQ ID NO: 1546 - DNA, 28 bp, Homo sapiens
gccagcacgggcggtggtggggacagcg

SEQ ID NO: 1547 - DNA, 89 bp, Homo sapiens
caccaggaggcgagtcccgtcacacacgaagccataggctgcacacccagggggaatgtcccccctcacggctgggatgaaccactggt

SEQ ID NO: 1548 - DNA, 2329 bp, Homo sapiens
atgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggaggaagggaaagaagtgaaaggatgaaatgaacaaaaggcagaaatggaaggggagaagagaaaccaatcaggaagtccttataaaattgcagcaaacacttagagtttcggagcttcgtgggaaccctatgtgctgagcccactttaaaacaagcgcaggtatatatacaaatccaggtagttctcaacactgtcacatctggtggcttgagggactaa

SEQ ID NO: 1549 - DNA, 158 bp, Homo sapiens
ggccgccgtacttgatggagatgaggtagctgccaggtgccatgggggtataggtgacgcggtagccctcagggcactcctggcaatccatcttcaccttggaggggccgtcaatggtcaccgacagggcaccagctcccgcattgctcgtgttcacg

SEQ ID NO: 1550 - DNA, 177 bp, Homo sapiens
cgggcacgccgtcataggtcacctccacctcatagggcccttcctcacggggcaggaagcgcaccacactgttgtcagcccccaggcctggctccaccttgcagggcaccgctgcacccgaggggcccacaatcttggatgccactttgccttgaccaccagcaccctttgatttga

SEQ ID NO: 1551 - DNA, 25 bp, Homo sapiens
cgctggtgctgtggtcgagtgaccg

SEQ ID NO: 1552 - DNA, 109 bp, Homo sapiens
agcgcccaggtcccagtgaaggttctcaactgtgacagcatcacccaggccaaagataagctgctggacactgtgtacaagggcattccgtactcccagcgtcccaaag

SEQ ID NO: 1553 - DNA, 31 bp, Homo sapiens
aggtcagggcccacgaggatgcggaggcaga

SEQ ID NO: 1554 - DNA, 129 bp, Homo sapiens
tggtttcctcagtggctacggcattagtgtttgggtcatctcttggcaaagaggagctggcagcatgggcggtaagaagggagctggcagaggatggctgcagggaggagggcgtgtaagagaggctct

SEQ ID NO: 1555 - DNA, 69 bp, Homo sapiens
ctttgtcttcaggacacgtgtgggtaaattcttcacgggcataggcattgtggagataacgccagactc

SEQ ID NO: 1556 - DNA, 139 bp, Homo sapiens
acgcggccaccgagctggaggaggcggcgggcgtgagaccgggaatgcttggggcccccgccttcctcgcagccatccagcactcggtgcacgccccgcgaggccagcggctgctccctcccggggctattgctgctag

SEQ ID NO: 1557 - DNA, 25 bp, Homo sapiens
gtagtgcaatctccagtggtcttca

SEQ ID NO: 1558 - DNA, 69 bp, Homo sapiens
tgcggcggcgcctgacaatgccccctcgcgccccggcctcggcgcccgctcccggctccagcgcgcctg

SEQ ID NO: 1559 - DNA, 35 bp, Homo sapiens
atgccatgccagagcccgacgtccttcttgaaatc

SEQ ID NO: 1560 - DNA, 203 bp, Homo sapiens
ctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctg

SEQ ID NO: 1561 - DNA, 55 bp, Homo sapiens
atggtggacggaggctcaaacatcgcagaggccgactgggagagtgtctccagca

SEQ ID NO: 1562 - DNA, 97 bp, Homo sapiens
ggtgagtgccttggcctgcggtgcggactgggtgttccttccagaatctccaccagaggaaggctgggaggagcagatgtgtgtcaaactctcggag

SEQ ID NO: 1563 - DNA, 32 bp, Homo sapiens
caggagaatcactggaacccagggggtggagg

SEQ ID NO: 1564 - DNA, 71 bp, Homo sapiens
cacgagaatcgtttgagcctaggaggtggaggttgcactgagctaagatcgtgccactgcactgcagcctg

SEQ ID NO: 1565 - DNA, 47 bp, Homo sapiens
tgggagcccgggacaatagctgctgttgtggccgctgtgttgtttga

SEQ ID NO: 1566 - DNA, 246 bp, Homo sapiens
agggacggcttcttctatctcgaatttttgcatttgtagggaattttatggggtagaggagcgaagagggaacaatgtctccaattcaaataaaaccccaaattaagctctcagccccatcggtgggatagcctgcgggggaacccactccctctcctggcagcattgccctgggggcgagcagagagtggatttggagtcttcttttcccgcctgacccctgctcgcccgagcagcattttcggg

SEQ ID NO: 1567 - DNA, 30 bp, Homo sapiens
gcatcaccgtgcagttcgcgggccgcggct

SEQ ID NO: 1568 - DNA, 24 bp, Homo sapiens
tgggagcatataagggaaattgga

SEQ ID NO: 1569 - DNA, 108 bp, Homo sapiens
agaggagttcaaacgtggaggccagactaaatccaggtcctggggctcttcttttagtttctctccttctttgccaactcgctgatagatccgcccagtgctgtcgtt

SEQ ID NO: 1570 - DNA, 56 bp, Homo sapiens
tggcggccatcggagttcacctgggctgcacctcagcctgtgtggccgtctataag

SEQ ID NO: 1571 - DNA, 25 bp, Homo sapiens
tggacgaatcaggagccagtagatt

SEQ ID NO: 1572 - DNA, 52 bp, Homo sapiens
acaacaacaaagcacgtgggcgatgacagcaagcgcagaggcggaaaggcaa

SEQ ID NO: 1573 - DNA, 128 bp, Homo sapiens
cgacactgatgcggtgaccgtggtgtggaaacccccagcactgatgctagaatcagagacgaatctcagcgtcagggcgctgctgaaggatgtgataggatggggcatgtcggtgccacagtaacggc

SEQ ID NO: 1574 - DNA, 30 bp, Homo sapiens
tccccggggacacctcggcacgcagcggag

SEQ ID NO: 1575 - DNA, 42 bp, Homo sapiens
tgcttgacagacgccttatagctcctcaaactaaatacatta

SEQ ID NO: 1576 - DNA, 75 bp, Homo sapiens
ccagtttaacagatgtggcccctgtgtatcttctcagattggcttcaactgcagttggtgtagtaaacttcaaag

SEQ ID NO: 1577 - DNA, 84 bp, Homo sapiens
taccacaggggctgtaagacctagtgaccctcctaagtgggaaagaggaatggagaatagtatttctgatgcatcaagaacatc

SEQ ID NO: 1578 - DNA, 24 bp, Homo sapiens
aagatatgttttgctcgttcatat

SEQ ID NO: 1579 - DNA, 29 bp, Homo sapiens
agtttggtgatacccccgtgctgcctcac

SEQ ID NO: 1580 - DNA, 68 bp, Homo sapiens
aaacggccccggccagcgggatcatggagaaccgggggttcggtccccactcgccaaccgctgccggg

SEQ ID NO: 1581 - DNA, 92 bp, Homo sapiens
ataggtccgccgacgatcttctacatcttcatcttgctttgcttgctgaaattcttgcctcagacgctgtatccgatcatgattgctaggag

SEQ ID NO: 1582 - DNA, 87 bp, Homo sapiens
gaaatcgtgcagtgaacctgtcccctccggtcacaacatcaagagctgaactgggactagaagtcatcgccccagagctttttgcta

SEQ ID NO: 1583 - DNA, 160 bp, Homo sapiens
tccctgatggataatgaaagctgaattgtcacagaagatttccccatattcattatattcataaggattgtcctttgtaagagctctctgatgtccaaaccttaaattcatgcagaaggacttcccgcaaatactgcatccatacggctccatttccaaa

SEQ ID NO: 1584 - DNA, 127 bp, Homo sapiens
atgtcagacccgaactggcctggagagagtcctgtaccactcacgagagctgatggcactaacactgggtttccaagatatccaaatgatagtgtatatgctaactggatgctttcaccctcagcgg

SEQ ID NO: 1585 - DNA, 35 bp, Homo sapiens
tcagggtgggtgtcaggtgatcttgggtgtggctt

SEQ ID NO: 1586 - DNA, 25 bp, Homo sapiens
accatggatggcctattattattat

SEQ ID NO: 1587 - DNA, 65 bp, Homo sapiens
ctaattactcagttggagcaaggggcagagccctggactgaggtgcgagaggctccatcaggcac

SEQ ID NO: 1588 - DNA, 304 bp, Homo sapiens
aatgccaccacaggacgtatgagttgtagccagcagagtgccccagtggtgccaggtgacagtcccccggaatacattagtgcatttgctaagactccatgtgttctcttgggcctcacagaacatgggctttgagggtgggagccaagaggcagacttgggagtgcccgaggccttgttctgaaacacctggggggctgacacccccactaccctcacacccctaccaccagtttccccaccagcgatgatggtagctactcagccagtgggctcctatatgcggttacacgtcagaatggcc

SEQ ID NO: 1589 - DNA, 67 bp, Homo sapiens
caccgactgccaagggcgtggtgaccattgagcagatcgtggacacgctgcccgaccgcggccgctc

SEQ ID NO: 1590 - DNA, 26 bp, Homo sapiens
tgcatcccggggtcgtgtgcatcatg

SEQ ID NO: 1591 - DNA, 111 bp, Homo sapiens
agatggagcatcgtggcgacagcagtgggttatcaccatcagtgatgtgatagagcagcctgctggtccccacagagtggaggtcttctggtgcactgtcggcctcattct

SEQ ID NO: 1592 - DNA, 29 bp, Homo sapiens
gacatctcctcaaataggaagcccaaatg

SEQ ID NO: 1593 - DNA, 154 bp, Homo sapiens
tcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctc

SEQ ID NO: 1594 - DNA, 80 bp, Homo sapiens
actctctgctcattgacccactcactcagcgcgacgcagggacctataagtgcatcgctaccaacaaaaccgggcagaat

SEQ ID NO: 1595 - DNA, 132 bp, Homo sapiens
agaatccaggacttgaatcgtatcttcccactttctgaggactactctggatcaggcttcggctccggctccggctctggatcaggatctgggagtggcttcctaacggaaatggaacaggattaccaacta

SEQ ID NO: 1596 - DNA, 73 bp, Homo sapiens
accacaacctgacactgggcaagatggcccacctgtggcatcccaggttcctgccctgtaaagaggagtctgg

SEQ ID NO: 1597 - DNA, 24 bp, Homo sapiens
tgcagcccatcagggacccacagc

SEQ ID NO: 1598 - DNA, 34 bp, Homo sapiens
cacacgtggtctgcagcattacgggcgtgccatt

SEQ ID NO: 1599 - DNA, 69 bp, Homo sapiens
gcgtcggtaagcagcagtgggccggccacgttgctgagcaccccgcagctcagcgtgttgagaaagatg

SEQ ID NO: 1600 - DNA, 25 bp, Homo sapiens
cgcccattccgcagcgggaggcggc

SEQ ID NO: 1601 - DNA, 89 bp, Homo sapiens
ggcatgtgtcaccccctgaggagctgtgccctcaaccatgaggatggcttctcctcagccttcgtgatagctcatgagaccggccacgt

SEQ ID NO: 1602 - DNA, 140 bp, Homo sapiens
gaggtctacgccacggacaaggatgagggcctcaacggggcggtgcgctacagcttcctgaagactgcgggcaaccgggactgggagttcttcatcatcgacccaatcagcggcctcatccagactgctcagcgcctgga

SEQ ID NO: 1603 - DNA, 53 bp, Homo sapiens
gtgtctttctgcaatatcgtgagggaagccgaggccctgaatcatcaaagaga

SEQ ID NO: 1604 - DNA, 28 bp, Homo sapiens
atcacaggcacctccgtgtcacccgtgg

SEQ ID NO: 1605 - DNA, 51 bp, Homo sapiens
agctcctcctgtccgacgggtaagaggaggccttggaggaatcatttcctt

SEQ ID NO: 1606 - DNA, 75 bp, Homo sapiens
gcttggcctatggcccccggagtttgaacagtgtccccaggagagaagttgaggtgctcgaaccccgtctgggct

SEQ ID NO: 1607 - DNA, 37 bp, Homo sapiens
tccatcccctccacgaggttaccaagggcctcaggct

SEQ ID NO: 1608 - DNA, 24 bp, Homo sapiens
agccttggaggagcactggcagtt

SEQ ID NO: 1609 - DNA, 140 bp, Homo sapiens
cttcgtccaggtacttggccggcaccacggccctgatgacttgctccttcagggccctgcgcatctcctccagcgtgatgtcttcgttgtgctgcacagagatgacgatggtgtggatgcgcacagggatgactgcgcca

SEQ ID NO: 1610 - DNA, 29 bp, Homo sapiens
ggagttgtcttccttggagtcgggctgtg

SEQ ID NO: 1611 - DNA, 36 bp, Homo sapiens
attctcagaaatcctccctagaccattttccctctc

SEQ ID NO: 1612 - DNA, 32 bp, Homo sapiens
gcccactggcttcggggagctcgaggtgctgg

SEQ ID NO: 1613 - DNA, 69 bp, Homo sapiens
tcccccgggcgcgcggctcatccacccgggcccggggcgaggccgagggcagcgcgaagcggggaggcg

SEQ ID NO: 1614 - DNA, 84 bp, Homo sapiens
ccagctacagtgagggccccgccgcccctgcacccaagccccgggttgtcaccactgccagcatccggccttctgtctaccagc

SEQ ID NO: 1615 - DNA, 26 bp, Homo sapiens
gcaccttctgcttgacctggtacact

SEQ ID NO: 1616 - DNA, 35 bp, Homo sapiens
aggactgccgctacgccccttatgacgccaccaag

SEQ ID NO: 1617 - DNA, 64 bp, Homo sapiens
ggtctctccccttctactgcctccaacacggcggcggcggcggctggcacatccagggacccgg

SEQ ID NO: 1618 - DNA, 110 bp, Homo sapiens
tgacatgagtaaaaaactgtactcttgctgcaaacagcaacagaggcaagtctgtgcccattctttggtcaaagatgaatagggagacacccgcttaatgtcttctttct

SEQ ID NO: 1619 - DNA, 30 bp, Homo sapiens
ggcgacagcgacgctcgcagcttcggagga

SEQ ID NO: 1620 - DNA, 58 bp, Homo sapiens
agagcaacctcgaacagtcatcaaagcaccccgcgtcagcactgcacaggatgtcatt

SEQ ID NO: 1621 - DNA, 91 bp, Homo sapiens
atcgtctatattgaggaggtccccaaagcgctcattagtgataaactgatggtgcgtcggaatgacgcctgtgtggcgtcgagctgcaata

SEQ ID NO: 1622 - DNA, 24 bp, Homo sapiens
tgcatggaagttggaagaatatat

SEQ ID NO: 1623 - DNA, 88 bp, Homo sapiens
gtgaaccggcctggtttcctgctctactggaggcggctcgtagctgtcatcagcgttctcctcggcgggcatcacgtacatctctgag

SEQ ID NO: 1624 - DNA, 58 bp, Homo sapiens
tgagaagagactattcagatagcaccaacccaggccccccgaagactccaccaattgc

SEQ ID NO: 1625 - DNA, 146 bp, Homo sapiens
cgtagccgtcgtaggcttccatgtagtcgtagccgcagtcggcctcctcctcaacctcaaaggtccggaatgtcagctccacgccgtagccgtcctctgccacgatcacccagtcacagcgggcctcgctcgggtagttgttgtcc

SEQ ID NO: 1626 - DNA, 137 bp, Homo sapiens
cacttcaaactgaagggagatccggtactgagcgggggccaccacctgccagacacagtttttgtttgtgggatactccttcggccacccagggctggtgatggttccattcagcttggtaatgaaaccgccacagg

SEQ ID NO: 1627 - DNA, 205 bp, Homo sapiens
atgcggtcaggtccgctgcggcctcccccgggcccaggggcgcttgcggggcccgtggctgcaaccgcggcgacggctcgttggagtctccgcacggcttccttgatgaggtttcccgagagcacgagctgctggaggagccgatgcgggtcgtcgtcgccggcgcgtgccccggcttgggtccatcggcgctgctgcaagcggc

SEQ ID NO: 1628 - DNA, 58 bp, Homo sapiens
tcagaaacttggtgacgagggtgtccacgtgaagactcatgacttggggtgcttccag

SEQ ID NO: 1629 - DNA, 115 bp, Homo sapiens
cactctgccctatcctcaggatggccactgcagacaggaggctctcgtcatggggaacagtggcaagcaagggtggctggaggacaggatgcaaaggcagactgcggccaccttg

SEQ ID NO: 1630 - DNA, 75 bp, Homo sapiens
agggtgctggccacaattcgtgctccctgggcggggggattggaccaagtaatccgcacgatcttctccatctgg

SEQ ID NO: 1631 - DNA, 91 bp, Homo sapiens
tgttaccaagcccggtcacctccacccctttctcagtcaaagacattttgaatctggagcagcagcaccagcacttccatggtgcgcactt

SEQ ID NO: 1632 - DNA, 138 bp, Homo sapiens
caggtctgagtcccgacaatccatttctggatccctgcctgccagtgggactcacagatgtggtggagaggaacagccaagtcttacatgtccgaggaagaggagactgggtgtcttgtggggcaatgctgagccccc

SEQ ID NO: 1633 - DNA, 153 bp, Homo sapiens
agcagacgaggccacagagggcaagaacacgtcctttcatgccacggctgagccagccctttctccaaaagtaggcagcaggcaggatgtacacaaggcctacaaggcgaccccacattcggtgtgagtactccatgtaccagatgaacttga

SEQ ID NO: 1634 - DNA, 201 bp, Homo sapiens
caggtgcccactctcagctagaggaagagggagcagaggcacagcccagcctagccagcagagagcaaatggaaaggcgtctgagagcagctgtttccacacagcctgggctcctgccttttgtagggggatgtctgtgcctgctggggagggagcggatgagaggacagggtggggaaggaccatcaatcctgtcaggag

SEQ ID NO: 1635 - DNA, 34 bp, Homo sapiens
attcttcttcatttagtcggtgaagttagttgtt

SEQ ID NO: 1636 - DNA, 29 bp, Homo sapiens
tcagctgctgacaaacccctggcatttag

SEQ ID NO: 1637 - DNA, 350 bp, Homo sapiens
aaggtcagatagctctgggagcgcgtgatggggggccggggtcggctgagggccagcagcaaagccgtcttgggagactcagagagcgcagagtcaaggcggcggccgggatgggggccgtccgagcggatggcggtgtccctgaggatgactgtgggccgcacgctgcaccaggtctccacccggcctcccgcatcgggctccgtctgcatggctgtgtccgcccgcccccagcctgggccgcggctgccgggctcctcctgcccgaggcagatgtccatgcggtccgacggcagggagcccgagctgtagggggcgctggaggcgcacgaagagacgctggagctgct

SEQ ID NO: 1638 - DNA, 78 bp, Homo sapiens
ggatccgggcgctgcgttggctgcggcctggcaccaaaggggcggccccggcggagagcggacccagtggcctcggcg

SEQ ID NO: 1639 - DNA, 109 bp, Homo sapiens
cccagctccccagatgttggagaagagctccaagacaggcacgctctcactgatatggtccagcttccgcaaatgcccgctctccaggatctctatgattttctcagcc

SEQ ID NO: 1640 - DNA, 53 bp, Homo sapiens
cggcagcgccccagtctccagttctgagacaccttcactcgttccttcactgg

SEQ ID NO: 1641 - DNA, 248 bp, Homo sapiens
cctggcggcctactgtgctgtcggggctggggaagtccgggctgaggctgagtctgggaatgggcccggggtctgaggtctacccggaggtcctggagcaggagagggaacactaggcagcaggtgagcgcagagccggaggcagagcggagctgagcgcggagccgagccgagctgcctctctcctcccgccccctccccgcggctgtcaccgcctcctcccctctttggcgctgccgggattggct

SEQ ID NO: 1642 - DNA, 33 bp, Homo sapiens
tgagcttcggctcggagcactacctgtgctcct

SEQ ID NO: 1643 - DNA, 220 bp, Homo sapiens
acgctgctacctccgcaggcgggggacggcgcaggcgagggtagcggcggcactaccaacaacggccccaacggcggcggcgggaacgttgcggcgtcgtcgtccactggcggggatggcgggacccccaagcccacggtggctgtctccgccgctgccccggcgggggcggccccggtgcccgccgctgctccggacgccggcgctccgcatgaccgac

SEQ ID NO: 1644 - DNA, 377 bp, Homo sapiens
gaactcaggtgtgcctgacccaaagctttgctcttcatcacatttgtacctcctgatacctccgggccttctcttcccactggaagtgctgccacccaccaacatacaccttgttttttgctcatcctaatcctccctgacttcagggcccataccaactcctacctcctggaagagccctcccagcccaccttggcccacaaagatctgagcaactcctcccaaataattaagaggagggaaactggaccccagaagtgggaatagagggaaggatggataaaaaaggatggaatcatgccaagatcaaaatgaatccttagatgcttgggacttatgtctcagagctgagggcggtgctgagaaacctatctgta

SEQ ID NO: 1645 - DNA, 35 bp, Homo sapiens
attctctgcgtggtggaggtcttgtccgtaggttc

SEQ ID NO: 1646 - DNA, 38 bp, Homo sapiens
agtcctgctgaatgatccggtggatctttctgtgcagg

SEQ ID NO: 1647 - DNA, 29 bp, Homo sapiens
gacttccagaactcctcccatcatgtcca

SEQ ID NO: 1648 - DNA, 62 bp, Homo sapiens
agcggtggcgagccacagggcggcgaccgtgagctccgggagctgcgcaaaccacctggaga

SEQ ID NO: 1649 - DNA, 29 bp, Homo sapiens
aaggtcacgtcgctcgacgggcgccagct

SEQ ID NO: 1650 - DNA, 36 bp, Homo sapiens
ctggccgtggtcatcggagtgttcgtggtgtgctgg

SEQ ID NO: 1651 - DNA, 66 bp, Homo sapiens
cggctaccccttcatcatgatccccgacctgacgagcccctacctccccaacggatcgctctcgcc

SEQ ID NO: 1652 - DNA, 67 bp, Homo sapiens
aggtcctcgggcagtgctgtgaacttgtgatactgtgtcctgtagtcgtggtcgctggccagagcct

SEQ ID NO: 1653 - DNA, 158 bp, Homo sapiens
tgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggt

SEQ ID NO: 1654 - DNA, 84 bp, Homo sapiens
caggagggcgcactggggattggaggcgagggaagtgcagggcgcatcccaggcggcagggctcccagcatcggcagtcgccat

SEQ ID NO: 1655 - DNA, 127 bp, Homo sapiens
aatcttgggccttggatcaactgcccacccttgaaccaatcctggtggccccaggctgattggcagacctgaatcacctatcccatgcccagaactttggcttgaccaggctcatccaaaacaaggg

SEQ ID NO: 1656 - DNA, 95 bp, Homo sapiens
cttcgagaacgacagcagatggccagccgtccctttgcttctgttgatgtagctctggaagtgggagctgaacaaacagagtttctgcgagggcc

SEQ ID NO: 1657 - DNA, 286 bp, Homo sapiens
taattcgtcttgcaggagtcctgcaaattcaaacagttgggcttctccctctcttcataggagcacacaggcacgatggtctgtcgcctccgctctgtgcaggcgatgtcccggcaggagcagaagagcattccgtagctgtgcttggccgggaccttgtcaaagaactgccggagggccttgtggcacttgcggcggttgcagacatcgttggacacgctggtggtgcacggggtgatgtacgccgacctgtacttcttgcaaatgtcgtcgaggttgcaggcct

SEQ ID NO: 1658 - DNA, 72 bp, Homo sapiens
gtcccgggcaatgtacacccaagccgtgcaaaacattcgggttgttggggcggagacagctttcttaataca

SEQ ID NO: 1659 - DNA, 310 bp, Homo sapiens
agattgattgccacctgccctaaaaatttatccagacccaccagggacctgtgcataactataaggaaaagaatgtatttctctggacttccctgaattagcaatccaggtagctcgaaagaggcctcctccttccaaactggctcaagggttttctcagctacagaggtggagtacttttccttgcccagctgaattatagtgtatgtgtcattggtaccacttttgccttttggcttcagatctttggcttggagcactgtgacctgcacgtgggttggaaaccacttttgggcttgctcggacagca

SEQ ID NO: 1660 - DNA, 71 bp, Homo sapiens
atctgagtggaggtcctcttcggtccctgtcgtctcttagatctcgtctttctcttagatcacgccggtca

SEQ ID NO: 1661 - DNA, 47 bp, Homo sapiens
gtgcagccactgttaagccatgtgttccaaggcattttagcggggag

SEQ ID NO: 1662 - DNA, 24 bp, Homo sapiens
agaaggtgttattgggaaaattca

SEQ ID NO: 1663 - DNA, 103 bp, Homo sapiens
agaaaacctaacggtggcagcggcggcgcctccacttcctcatcgggcactaacttacttttctcctcctcggccacggagttcagcttcaatgtgcccttca

SEQ ID NO: 1664 - DNA, 75 bp, Homo sapiens
tcagtctcccaccagacggtgcagcagctggttctggagaaggagcaagccctggccgacctgaactccgtggag

SEQ ID NO: 1665 - DNA, 36 bp, Homo sapiens
tgaagagagatgagctacccacaccttctatgtctt

SEQ ID NO: 1666 - DNA, 24 bp, Homo sapiens
tgaagaccgccgagaacatcagag

SEQ ID NO: 1667 - DNA, 107 bp, Homo sapiens
gaccatccacctgatgggaagaaagctagaaaagcccaaccctgagaaaaatgcttgggaacacaacagcctcacaattccgagtccagcatgtgcttcggaggcca

SEQ ID NO: 1668 - DNA, 25 bp, Homo sapiens
cctggacggccgttggggccgccat

SEQ ID NO: 1669 - DNA, 28 bp, Homo sapiens
gcctccgcagctgcatttcggtcctgca

SEQ ID NO: 1670 - DNA, 139 bp, Homo sapiens
tcgtgtttggggagcccatcaccgccagcctgggcaccgacggttcacactactggagcaagaactgggccaaggccgcagccttcgtcacatcaccccctgtcaacccagaccccaccacggcggaccacctcacctg

SEQ ID NO: 1671 - DNA, 145 bp, Homo sapiens
atactgtagctgtctgcaggtaacaaactgcagaaagtgaactgcgggtaacgaggcactgccggtgtgatttacacgtccaataatgggactggtggaggatgttctggatcatcagcatcatgaaattttacgccgtccgtaa

SEQ ID NO: 1672 - DNA, 78 bp, Homo sapiens
ggcccttccgggagtacgagctgtgggccctgtgcctggcctgcctccgcgcactgcagacacgccctgagcacccag

SEQ ID NO: 1673 - DNA, 58 bp, Homo sapiens
ctccagcgaggcatggacagccggaaaatccttgcccacctcagagcttccatctgcc

SEQ ID NO: 1674 - DNA, 122 bp, Homo sapiens
gcttcagcggtgccgacatttccacactcgccgcagatagcagggccaacttccaccaggtctccagcgagaagcactcacggaagattcaggacaagctacggaggatgaaggctacattc

SEQ ID NO: 1675 - DNA, 33 bp, Homo sapiens
gcatcaaggaggccgccgggtcctcaaatctgc

SEQ ID NO: 1676 - DNA, 93 bp, Homo sapiens
cgaagcgttcctggcagcggcagccctggacgttctcatcatggtccatgcccaggttgtggcccatctcatgggccatggtacaggccacgc

SEQ ID NO: 1677 - DNA, 49 bp, Homo sapiens
ataccctctaccatctgctttggtcagggtgccgctcgaggatttaaaa

SEQ ID NO: 1678 - DNA, 45 bp, Homo sapiens
ccgtgccccatccgcgccagcgcgtagagcagctcgggggacagc

SEQ ID NO: 1679 - DNA, 104 bp, Homo sapiens
tgcttgcttggcgtcctgggctgagatccggtcaccagtgaggaccatctccatcgccagcgacttcccaacagcacgggtgagtctctgggtgccgcccgcac

SEQ ID NO: 1680 - DNA, 123 bp, Homo sapiens
agctggctgctgagtacgggctgctgggggagaaggagctgtcccaggagaaccagctggtggagaccgggggtcacgtgggcctgccctccgtgagctacgccagctccggggccagcgtga

SEQ ID NO: 1681 - DNA, 30 bp, Homo sapiens
agacgaggtgcagcgccgagccttcctctt

SEQ ID NO: 1682 - DNA, 26 bp, Homo sapiens
acggtaacttcctgctgtcggccctg

SEQ ID NO: 1683 - DNA, 103 bp, Homo sapiens
ccctcagcagtcaagtacctcatggcttcagaccccaacctgcaggtgctgggagcggcctacatccagcacaagtgctacagcgatgcagccgccaagaagc

SEQ ID NO: 1684 - DNA, 162 bp, Homo sapiens
gtggaacctttcatccagcgaccacctgaaggaccgcctggccagagacacgctggagcagctcacagacctggtgttgagccccctgtcgggggctgggggtccccccctcatccagcagaacgcctcggaggcagagatcttctacaacgccaccggctt

SEQ ID NO: 1685 - DNA, 149 bp, Homo sapiens
catccttggacaccaggcagtagaagtctgtgcgggcactgtagtttcgcgagccgagatccgagacgtccacttcgctgctccggctctctcccagcgagaccccactggtgtgcggtggagctgatggctctccaaagacaggcccc

SEQ ID NO: 1686 - DNA, 27 bp, Homo sapiens
ctgcccaacctggaccaactgaagctg

SEQ ID NO: 1687 - DNA, 39 bp, Homo sapiens
tgttttcagagaggtcgcttgggtccatcagagtctctg

SEQ ID NO: 1688 - DNA, 287 bp, Homo sapiens
ggtgtcacagttccgaggcagcaggcaggctggggtggaggggctggcggagcctgggggtccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtataggaacgtgcagctcgggt

SEQ ID NO: 1689 - DNA, 129 bp, Homo sapiens
ggtgtttgagaccaccggctcccaagtgcgtcgccttgggggtttgcatcggctcctcagcctccccaggcaatctctgtgtagggtcgggagcgggaggtctgagatgagccgggtgcctgagatctc

SEQ ID NO: 1690 - DNA, 26 bp, Homo sapiens
gggcatcggctgagaggttcctgcct

SEQ ID NO: 1691 - DNA, 47 bp, Homo sapiens
tgcaggatgggcatgttggaccctgacgggcagagcagacccgcgct

SEQ ID NO: 1692 - DNA, 25 bp, Homo sapiens
tttccgccgtcgggagtcgcaggag

SEQ ID NO: 1693 - DNA, 80 bp, Homo sapiens
cggcagtggtggaagctgcgcagccgcagcggccaggcggggtacgtgccctgcaacatcctaggcgaggcgcgaccgga

SEQ ID NO: 1694 - DNA, 34 bp, Homo sapiens
ggccaagcccatgcgtcggatgctgtcctggtac

SEQ ID NO: 1695 - DNA, 125 bp, Homo sapiens
cagctgcacggtgaccggttggaggaagctggggggaccgctctgtgacaggcacagcagggggctcactgcagcctctggttctcccaggagggcctgcagctctcggccagccatgcgcacca

SEQ ID NO: 1696 - DNA, 98 bp, Homo sapiens
ctggaagtgagcatgccccatttcatgagaaccaacagcttcgccgaggacctggacctggaaggggagactctgctgacacccatcacccacatctc

SEQ ID NO: 1697 - DNA, 36 bp, Homo sapiens
cccggatcaactggacttttgccccctgctccgcca

SEQ ID NO: 1698 - DNA, 70 bp, Homo sapiens
gtgttcgacctgaaggccatcgcctccctgctgcggctgccagacgtcccgaggatcttcctggtgaagg

SEQ ID NO: 1699 - DNA, 24 bp, Homo sapiens
tatatggggaatacatgtattaaa

SEQ ID NO: 1700 - DNA, 24 bp, Homo sapiens
acagaaggctttctctcaaggcca

SEQ ID NO: 1701 - DNA, 27 bp, Homo sapiens
tgctgatgtcttgctctctaccaccac

SEQ ID NO: 1702 - DNA, 73 bp, Homo sapiens
ccaggctgaaggaccaattgtgccgcctgccgggccctggttggactgtgtgcatgccgcaggagtaactccc

SEQ ID NO: 1703 - DNA, 24 bp, Homo sapiens
gggaaggtcaacgtcccctcctca

SEQ ID NO: 1704 - DNA, 76 bp, Homo sapiens
ccagcaatcattcccaggtgatcggccagtgtttttttaggctcactcgtctggtctggtctgattccaagattcc

SEQ ID NO: 1705 - DNA, 86 bp, Homo sapiens
cctggtggctccatcggccgcgttcatcagtcagcacgacccgacctcagtggcgtcctcacaacacagaccggaccttgggtctt

SEQ ID NO: 1706 - DNA, 188 bp, Homo sapiens
cctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctcca

SEQ ID NO: 1707 - DNA, 31 bp, Homo sapiens
gcccaatcggccatccaaggtctttcctgca

SEQ ID NO: 1708 - DNA, 24 bp, Homo sapiens
gattgaagatgtccccacactcct

SEQ ID NO: 1709 - DNA, 74 bp, Homo sapiens
gcgacactgagtctccagtcccgagaggtgcccgagggaaaaggaggcggcagctaaactggtcctggagagaa

SEQ ID NO: 1710 - DNA, 116 bp, Homo sapiens
ttgaacaggaagtatcactggacctgattttagtagaagagtatgactcattaatagaaaagatgagcaactggaattttccaatttttgaacttgtagaaaagatgggagagaaa

SEQ ID NO: 1711 - DNA, 134 bp, Homo sapiens
caatggggctagggatgctgcttttgtttggcagattgacagggctggttttgctggctgggaagaggttctgggtgggagacgttggggactttacaggctctgctgtcttgggtcgggatgagagattcaga

SEQ ID NO: 1712 - DNA, 24 bp, Homo sapiens
gatctgtgaaggagtaaggccctt

SEQ ID NO: 1713 - DNA, 48 bp, Homo sapiens
ggcgactccgacgcgtccagcccgcgctccaactgctccgacggcatg

SEQ ID NO: 1714 - DNA, 25 bp, Homo sapiens
aaatagcagccaccgctccctggca

SEQ ID NO: 1715 - DNA, 24 bp, Homo sapiens
cttgttgtgagtcaagtgatcagt

SEQ ID NO: 1716 - DNA, 31 bp, Homo sapiens
aggccggtcccgagctaggtcccaggactcc

SEQ ID NO: 1717 - DNA, 581 bp, Homo sapiens
aacaggtttgtcgtggccctcacgaagtgagggttgggagctattgccagatcctgccttgatcctctctcctggcatggatttggatgaagacaaagcgaggtgtttctcattggccatgctgggtcttgatttcttctcagcatgaggaaggggcattcctttggaagaaggatgcctgtctccagaacctttgctaagttttgtgcccacactttctttctgagagggtgcctttttggacacagttggaggtagttttccatctgtctcaagtttttttctcctatgctttcgttcaaggaattctcgctccctaagttcttctgcggtcataggtcgctcttctgatttcttcactaccttgatttccactggttcaaactgctttttctcagccagcctgagtaaatcagtgaagttcatgggtggtggggcacttttaagggggacctttggtttgctttcaactttgggaggttcttgctcttcctcatactcctgctctgactctgcgtgattgtactcgaggaattcattctcttcttccatttcatactctcggtcggttccttggctgg

SEQ ID NO: 1718 - DNA, 26 bp, Homo sapiens
cagcaggtgccagtcactccccaagc

SEQ ID NO: 1719 - DNA, 30 bp, Homo sapiens
gacccgcaccttgataggaacactttgcct

SEQ ID NO: 1720 - DNA, 33 bp, Homo sapiens
gaaagagcaaaatgatccgagacctccagaatg

SEQ ID NO: 1721 - DNA, 31 bp, Homo sapiens
aagctgctctgccggtagtgggctttcttct

SEQ ID NO: 1722 - DNA, 124 bp, Homo sapiens
ttgtctccattgccgccttctgtggaggatgcaggattaccttcttatgaacaggcagtggcgctgaccagaaaacacagtgtttcaccaccaccaccatatcctgggcacacaaaaggattta

SEQ ID NO: 1723 - DNA, 26 bp, Homo sapiens
aaaaatctatgtctctcccatctcac

SEQ ID NO: 1724 - DNA, 24 bp, Homo sapiens
ctgacatctaacctctcctccctg

SEQ ID NO: 1725 - DNA, 32 bp, Homo sapiens
tgtgcgcgactcggggtgattcacgccgggga

SEQ ID NO: 1726 - DNA, 132 bp, Homo sapiens
tgacccgcggcttcgctcccattctgcccgtcgagttccacaagatgggctccttccgcaggcctagaccgcgcttcatgagctcccccgtgctcagcgaccttccccgattccaagcagctcggcaggctc

SEQ ID NO: 1727 - DNA, 68 bp, Homo sapiens
atgtcctgcgcctcagggtccggtggtggcctgcggcatcccttgcggtgccagaagccgtgggacga

SEQ ID NO: 1728 - DNA, 55 bp, Homo sapiens
cgcagtgatcctgggcttcggggtgtggatcctggccgacaagagcagtttcatc

SEQ ID NO: 1729 - DNA, 25 bp, Homo sapiens
ctcctggaccaccctcaagcttcag

SEQ ID NO: 1730 - DNA, 60 bp, Homo sapiens
cagatgggggattgaggcttcggcctgagggcactgcccattggcggcaccacctgtggg

SEQ ID NO: 1731 - DNA, 38 bp, Homo sapiens
gtgccacatggcaatctgccggcgagggtttttgagca

SEQ ID NO: 1732 - DNA, 78 bp, Homo sapiens
ctgtccagtggaacgatagggggtgaagtctggaggccagccttgaaccagagcagcaggagcatccgcagtacagcc

SEQ ID NO: 1733 - DNA, 96 bp, Homo sapiens
tggccagctggacgagggcgatgacaagccagcggcccacttcaccccacaccttggcagctcccatctccatgaacacctccacgcactccagca

SEQ ID NO: 1734 - DNA, 123 bp, Homo sapiens
tggatgccagaagagcgggaggacagcatgtgcaggaaattgtggaggagaggcgtccggcgaactggctgtgattgcaggagggcacgctgacggtagtgggataattctgttccatctatg

SEQ ID NO: 1735 - DNA, 57 bp, Homo sapiens
tgcacttcccggaccacttgggtgttggccgacctccggaagatgccctcggtggtg

SEQ ID NO: 1736 - DNA, 117 bp, Homo sapiens
tgaagaaaagaagccgctggcgctcggcggcctggcaggtctcaaaggcctgttccatgtcctccatgtagcgtggagtgtagcgatgcagctctgccagcgtctgctcatactgag

SEQ ID NO: 1737 - DNA, 127 bp, Homo sapiens
gcgttccacccgttcctgcagtttgcgcagctgctcctgggagacggcgctgtctgcctttgcgtggctctccctcgtctgggcggtcttctcatccttccgggctgcgtggtagcttttcttggaa

SEQ ID NO: 1738 - DNA, 50 bp, Homo sapiens
atgcagaagtgctgcctatcctgccagaaccagaatcactagagctgaaa

SEQ ID NO: 1739 - DNA, 40 bp, Homo sapiens
acagcatggagcgcgctgccgcccgacagcaaagcatcaa

SEQ ID NO: 1740 - DNA, 189 bp, Homo sapiens
agtgtgtagaccacgggatttaacattgggaccaccatagtataaaatacagcaacagctttatcaatgggcagagtggtcactgagcgcagatacacaaatatacagggcacaaagaataagacaactactatgatgtgagaaatacaggtggagagggctttacacctcccctccaagctattgttc

SEQ ID NO: 1741 - DNA, 24 bp, Homo sapiens
taaatcgtttaagaatagtcaata

SEQ ID NO: 1742 - DNA, 280 bp, Homo sapiens
gctgccataggtgccgagtgacacatctctcttctgaaactcccagtcctgctcatcggcatcctggctgctgtacctaccatggtggtccctcttccccaaatcttggccctgctcgttggcatcttggctggcataagcacccagagaatctctcttcccaaattcccagtccccaaggcttacatctcgactactgtaggtacccagtgaatctctctttccgaattcctggtcctggagttctgcatcccggctggagtaagtgccctgggaatcc

SEQ ID NO: 1743 - DNA, 126 bp, Homo sapiens
cctcgtcaggcagggctgcacttggagctgatggagtcacagcggggcagggagaagcctgggaagcttcaggagtctgggcttccagaagctgtgagtggcagggagaactcttatcaggcgggt

SEQ ID NO: 1744 - DNA, 27 bp, Homo sapiens
tctctcccagtttcacactcccagagc

SEQ ID NO: 1745 - DNA, 266 bp, Homo sapiens
cttgttcgcggacctggccaacctgagccacctcttcctccacgggaaccgcctgcggctgctcacagagcacgtgtttcgcggcctgggcagcctggaccggctgctgctgcacgggaaccggctgcagggcgtgcaccgcgcggccttccgcggcctcagccgcctcaccatcctctacctgttcaacaacagcctggcctcgctgcccggcgaggcgctcgccgacctgccctcgctcgagttcctgcggctcaacgctaacc

SEQ ID NO: 1746 - DNA, 141 bp, Homo sapiens
cctggccaccagtcacaaggtactccagcatcttgttcacagcagccatgtagaagatgatccgcagctgggtcatgcccatggtgaggaggctccacaggaaagtgggggagcagaggctcttgcgtaaggggacagacc

SEQ ID NO: 1747 - DNA, 25 bp, Homo sapiens
ggccgtgttgggggatgctttggta

SEQ ID NO: 1748 - DNA, 63 bp, Homo sapiens
cccggcactgagggcaacggccgcgcgccggctccgagacgagcgacgcctggcgggagcgcg

SEQ ID NO: 1749 - DNA, 27 bp, Homo sapiens
aacaacggccccctgaggcggtcgcgg

SEQ ID NO: 1750 - DNA, 24 bp, Homo sapiens
gcttctttccctcaagaagatgat

SEQ ID NO: 1751 - DNA, 31 bp, Homo sapiens
cgcaggagcggcgcactagcgcgagccagca

SEQ ID NO: 1752 - DNA, 118 bp, Homo sapiens
cttcaagttgtaggctccggccagattcatggcaatcaggatgctggggtttgggtaggctgatgaagtcaccgagttctccatgagtacttgtattccattgaccaagggctcctgt

SEQ ID NO: 1753 - DNA, 32 bp, Homo sapiens
cgccgaggccgtgtgccgagcactgggctgcg

SEQ ID NO: 1754 - DNA, 33 bp, Homo sapiens
agcaatagctatcaaccggtccccatcaccatc

SEQ ID NO: 1755 - DNA, 179 bp, Homo sapiens
ggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacaca

SEQ ID NO: 1756 - DNA, 71 bp, Homo sapiens
ggctcccggagaatcagaaactcatacgttttcttggacaaagcaccattctctatggagaccaggggcct

SEQ ID NO: 1757 - DNA, 51 bp, Homo sapiens
tggccagaggctccaagcgggaaacagccttcagccgagggaatgaaagga

SEQ ID NO: 1758 - DNA, 26 bp, Homo sapiens
tggagaattcgatgtccatcacctcc

SEQ ID NO: 1759 - DNA, 30 bp, Homo sapiens
agccttccacagagtctccacacccaccag

SEQ ID NO: 1760 - DNA, 27 bp, Homo sapiens
gctaagcgcaaggagccagaacccaag

SEQ ID NO: 1761 - DNA, 84 bp, Homo sapiens
cagatctttgacgatagttgccaggggcagccgcaccagagggtgaatcttcaatggagtcttggcggccttaggaagtcgaat

SEQ ID NO: 1762 - DNA, 29 bp, Homo sapiens
tgctgaatataccggtctgtggttttcca

SEQ ID NO: 1763 - DNA, 96 bp, Homo sapiens
gtgggtggctggtaatgattcaaattgccgagaaagaaaaagttcccggtgcttcagttgatggcgctgctgctcagacacccctggctgctttga

SEQ ID NO: 1764 - DNA, 132 bp, Homo sapiens
ggctgctaactcctcggccttttccctccgcctctcctcagcagcccggcgcatctcatcttcctgtagccgctgtcgtgctgctgacaactcttgcccttgtctcctgcgctgccgttcccgttccaatgc

SEQ ID NO: 1765 - DNA, 38 bp, Homo sapiens
gtgaagggcacactgcacttgctctgaatcatgctcag

SEQ ID NO: 1766 - DNA, 27 bp, Homo sapiens
gctgtacgacttcccctcgtccgccat

SEQ ID NO: 1767 - DNA, 120 bp, Homo sapiens
agctgaatgagttagagcccgagaagcagccgatgaacgcggcgtctggggcggccatgtccctggcgggagccgagaagaatggtctggtgaagatcaaggtggcggaagacgaggcgg

SEQ ID NO: 1768 - DNA, 230 bp, Homo sapiens
atctgaggccattgacaaagtgctcacagttcccttcaatcaggctgtactgcacgatcttgttgaccatcttttttgtacgctggatgatcttgtccaccggcaagggcaggtacgtcccatctagcttgttattgaccttccaggagcagccatgcagcacatcctccagacgactgtatttcaccacggcccgattgctaaagatggaagtaatgctgcccacctca

SEQ ID NO: 1769 - DNA, 205 bp, Homo sapiens
agaggtcgccactgaggttaggagaggcaggaggtcagcgtggctagggtccggcggggtgggagcccacctggtagccccagcgctctccacgacccccacgagccagggcgtcagaaaagtttgtgcagaagtgggggacgcaagggatgagcgcaaggtccggtgcggctggggcgtgattactatgtacgcccctcagggt

SEQ ID NO: 1770 - DNA, 24 bp, Homo sapiens
aagccaagcgaacctatgaggagg

SEQ ID NO: 1771 - DNA, 82 bp, Homo sapiens
gccccgcaccccagatcgctggtgcgccccgcagggtggtccgggaggcagggccgacgtgccgacggaccgggcggaagcg

SEQ ID NO: 1772 - DNA, 103 bp, Homo sapiens
ataccactacgtctgcctgcggaacgaggccaaccaaccgctgtgcctgccggccctgctcatctacaccgaagcctcggactacattcctgacgaccaccag

SEQ ID NO: 1773 - DNA, 46 bp, Homo sapiens
gggtgtgctgtttggagttcctggggccttcacccctggatgttcc

SEQ ID NO: 1774 - DNA, 32 bp, Homo sapiens
catgatgctgtcggggcaggtccccttccagg

SEQ ID NO: 1775 - DNA, 92 bp, Homo sapiens
ggctgccagaatccgcccggtggctgattattaagggcaaaccagaccaagcacttcaggagctcagaaaggtggccaggataaatggccac

SEQ ID NO: 1776 - DNA, 26 bp, Homo sapiens
gcacgaagggggatcgggtggccacg

SEQ ID NO: 1777 - DNA, 77 bp, Homo sapiens
cagccccacggatgatgcccaggacgttggaagagttcctcagctccaggcggttgtagacgctcacattcacctgg

SEQ ID NO: 1778 - DNA, 151 bp, Homo sapiens
gctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaag

SEQ ID NO: 1779 - DNA, 28 bp, Homo sapiens
agatgggacgacgaagactggggcagcc

SEQ ID NO: 1780 - DNA, 116 bp, Homo sapiens
ggcactggcgctgcgcgggactgtactcggcagggggcgtgcaggcacagcggtagccgccgcgcgtgttctcacacactccgttccggcagttggactcgtccaggcactcgtcc

SEQ ID NO: 1781 - DNA, 125 bp, Homo sapiens
atcagaacttcttcgggatggacgagtcgctgggcccggtggcagtgagcctgcggcgggaggagaaggagggcagcggagggggcaccctgcacagctaccgcgtcatcgtgcggaccacgcag

SEQ ID NO: 1782 - DNA, 62 bp, Homo sapiens
gagataatcgagggctgccgcctacccgtgctgcggcggaaccaggacaacgaagatgagtg

SEQ ID NO: 1783 - DNA, 134 bp, Homo sapiens
ggcactggccgactacgagaatgccaacaaggcgctggacaaggcgcgcaccaggaaccgggaggtgcggcccgccgagagccaccagcagctgtgctgccaacgcttcgagcgcctctccgactccgccaagc

SEQ ID NO: 1784 - DNA, 114 bp, Homo sapiens
cacaggagcggttgttaggccccagctggaagcccggctcgcactggcagcggaaggagccaggcaggttcacgcagcggtgctggcagtagcggtagcggcactcgtctatgt

SEQ ID NO: 1785 - DNA, 52 bp, Homo sapiens
aattgcgcagtacctggccacttatggccccatcaccgtgaccatcaacatg

SEQ ID NO: 1786 - DNA, 36 bp, Homo sapiens
ggctggagcggagggacttgctgggggttggattgg

SEQ ID NO: 1787 - DNA, 82 bp, Homo sapiens
gctggctttctagagtgtgtgggggagagcgtggggagcagcagtgactgttaatgcaggaacggtaatttctgatggtggt

SEQ ID NO: 1788 - DNA, 36 bp, Homo sapiens
gatggagaccatccaggctagtacggtgaaacccca

SEQ ID NO: 1789 - DNA, 285 bp, Homo sapiens
agtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagggcttcccgcgaaggaccggaaaggagcgcctactaaggacgccgtcgaggtccggggcgcctcaactctatagctcta

SEQ ID NO: 1790 - DNA, 39 bp, Homo sapiens
tgaggatggctgcgatggacggcaaggactggcccaggg

SEQ ID NO: 1791 - DNA, 46 bp, Homo sapiens
cagaagtcaaagaagtacgagaggcccagggcgatgatcttgagca

SEQ ID NO: 1792 - DNA, 35 bp, Homo sapiens
ctttccccaaggtagcacatctggctcactcccca

SEQ ID NO: 1793 - DNA, 59 bp, Homo sapiens
cgaggacggcgctggcgacggcggggaggtgcccgcgctcatcccggacggcgagccgc

SEQ ID NO: 1794 - DNA, 138 bp, Homo sapiens
tactgccgaaagcgctcgtcgaaggtgggcaccttgcctcctgccacgtagaatggctcccaggggtcctgccaaggtaccacgtaggcgggccgcagcaagctctcttccggcaggttgacccagcgggaatagttg

SEQ ID NO: 1795 - DNA, 34 bp, Homo sapiens
caccatggctgtgatggcggggaagacggacagg

SEQ ID NO: 1796 - DNA, 60 bp, Homo sapiens
actacgctccctgctggaggggttgctgcagagggatgtcaaccggagattgggctgcct

SEQ ID NO: 1797 - DNA, 29 bp, Homo sapiens
tggagcaggcgatccgtgctgagctgtgg

SEQ ID NO: 1798 - DNA, 62 bp, Homo sapiens
tgaagtcccgccagtcagtggttaccctccagggcagtgccgtggtggccaaccggacccag

SEQ ID NO: 1799 - DNA, 29 bp, Homo sapiens
ctcgtggagtcagaccccaaccactttgc

SEQ ID NO: 1800 - DNA, 111 bp, Homo sapiens
ctgtggctcagtgggcgtgaagctgcccggccgctcctcgcagagagctgccgcgaaggacgagagcacggagcgcagcagggtccggaggtcggcactggccatgaggca

SEQ ID NO: 1801 - DNA, 120 bp, Homo sapiens
acttctggtagcggggcacggtcagtggggcgatggcctggaacttcggggccagcaggggctcgaggcgtgaggcgcaggggtcagccgcgtggaagaggttgtagatctgttcacagg

SEQ ID NO: 1802 - DNA, 30 bp, Homo sapiens
ggatccagtgggcctacaccagcaagcact

SEQ ID NO: 1803 - DNA, 49 bp, Homo sapiens
aggacacaatctggcgcatccactgggcacccttggctggcgagtcggg

SEQ ID NO: 1804 - DNA, 183 bp, Homo sapiens
cctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatc

SEQ ID NO: 1805 - DNA, 115 bp, Homo sapiens
gaacgcgtgcaggacgggttccttggggtccgccgggcccaggtacgcttctttgaagacgtggaactcgtcctcctcgtacttcacgggggccttcaggccgatgttctccgaa

SEQ ID NO: 1806 - DNA, 24 bp, Homo sapiens
aacttggtccttgacttataatcc

SEQ ID NO: 1807 - DNA, 89 bp, Homo sapiens
agtcgcatgactcagtggtgcaggagcgcacggtctccgtcctcccctctcggaagagccgggtcatggaggcctcgtatgtgaggcaa

SEQ ID NO: 1808 - DNA, 24 bp, Homo sapiens
caatgctgtttatccggaggacag

SEQ ID NO: 1809 - DNA, 29 bp, Homo sapiens
tccagacctcgctgtttcggaggcggctg

SEQ ID NO: 1810 - DNA, 152 bp, Homo sapiens
ggtcgtggccctagatcctggacgcagcgctcctgctctgacggcgcggcggctccgggccggcagccttatatagtagcgccttacgggccccacgggtaggtgcccaagacacccgagcatttcttatcgggattgcatcaagcctccgc

SEQ ID NO: 1811 - DNA, 25 bp, Homo sapiens
gcagcccactctgtagctgccgcac

SEQ ID NO: 1812 - DNA, 41 bp, Homo sapiens
ggccagccgggcatcctgaccgatgggcaccctctcccagg

SEQ ID NO: 1813 - DNA, 91 bp, Homo sapiens
tttcggcggcaaatacggtatcgacaaggacaaagtggataagagcgccgttggctttgagtatcaaggcaaaacggagaagcacgagtcc

SEQ ID NO: 1814 - DNA, 26 bp, Homo sapiens
cccaccggatgaccgggatgcctcag

SEQ ID NO: 1815 - DNA, 72 bp, Homo sapiens
ggtcctagtccggctctcctgggtcctccgcggaggctccgacaacgtcgacgcggctgcagatgctgacgc

SEQ ID NO: 1816 - DNA, 1231 bp, Homo sapiens
gatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattgagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatg

SEQ ID NO: 1817 - DNA, 97 bp, Homo sapiens
agggcacattatgcaggccctgccccccaggcaccttctcagctgcatggggctccagcccatgccagccccatgcccgttgcagcctttggaggag

SEQ ID NO: 1818 - DNA, 62 bp, Homo sapiens
ggatgcccaatagatagaagacgggtgagccatccactgattcattacaggctgtggcatcc

SEQ ID NO: 1819 - DNA, 63 bp, Homo sapiens
tcagcctgccgctcttctttatcggctgctccagccaccagattgcgggcatcacacaccaga

SEQ ID NO: 1820 - DNA, 37 bp, Homo sapiens
gtgcattagggtgaagggcagttccacggccacgtcg

SEQ ID NO: 1821 - DNA, 55 bp, Homo sapiens
ctggcactgcggagaagttgagccccaaggcggccacgcttgccgagcgcagcgc

SEQ ID NO: 1822 - DNA, 190 bp, Homo sapiens
tcggaaaacttggcccccatgaggagcccgtagctgaggttgtccgcacatcctccccagcggttcccgggcccgggtggctcacctgggacggggccgcaggagcagccgggcaggtcgccggaggtgcaggcccgggcgatggcgtggctgatggcggcggccgacagcgcatacacgaaggccgact

SEQ ID NO: 1823 - DNA, 24 bp, Homo sapiens
gaccggggacaccgggtctcctga

SEQ ID NO: 1824 - DNA, 107 bp, Homo sapiens
cggcctggtaaagggccacgcatacgccgtcactgatgtgcgcaaggtgcgcctgggccacggcctactggccttcttcaagtcagagaagttggacatgatccgcc

SEQ ID NO: 1825 - DNA, 120 bp, Homo sapiens
ctctggacttataagcgcttaacataaacaacaacaagaaaagtatcgtggtagccttgcctatgagcctgcagtttttaatttgtctgagtcctggacctcagcctagatgtaaccttg

SEQ ID NO: 1826 - DNA, 40 bp, Homo sapiens
aagcaacttgaggggcgaggtgaggtcttactctctgggt

SEQ ID NO: 1827 - DNA, 84 bp, Homo sapiens
gacttgggtggctactacttcaggttcttgcctcagaaaaccttccagtctctgagctctaaggagatcaccagccggctccgc

SEQ ID NO: 1828 - DNA, 139 bp, Homo sapiens
gcggggactcggagaccgacctggaggcgctcttcaacgccgtcatgaaccccaagacggccaacgtgccccagaccgtgcccatgaggctccggaagctgcccgactccttcttcaagccgccggagcccaaatccca

SEQ ID NO: 1829 - DNA, 81 bp, Homo sapiens
ccacagcgaggcttcttgatcacgttcattgtggtctggtctaacttcccggtgacttggaggccaaagaacgcttgtagc

SEQ ID NO: 1830 - DNA, 96 bp, Homo sapiens
agtatttctccacggagtgtggtgatagcatcaaatgtcaaactggggtcacagggtttgggtgtgcttggtccagtaggttggatagggttgctt

SEQ ID NO: 1831 - DNA, 96 bp, Homo sapiens
ctttagtagctttcccaaaactcaaacggcaagttttgttgtatgaacctcaagtcaactcacccaaagactttacagaaggtaccctcttctcag

SEQ ID NO: 1832 - DNA, 54 bp, Homo sapiens
ttggatcttggaaattccgtattgttgaatgagggccagacaaagtggtacttt

SEQ ID NO: 1833 - DNA, 26 bp, Homo sapiens
caatacaagccgggctacgtccgagg

SEQ ID NO: 1834 - DNA, 29 bp, Homo sapiens
ctgttttactgacgttgatagctgtggtt

SEQ ID NO: 1835 - DNA, 111 bp, Homo sapiens
tggagggcatcgtcaccatcgtgggcctgaagcccgaaacaacgtacgccgtaaggctggcggcgctcaatggcaaagggctgggtgagatcagcgcggcctccgagttca

SEQ ID NO: 1836 - DNA, 33 bp, Homo sapiens
gggacgggtcggggagagtcagctggtggtggc

SEQ ID NO: 1837 - DNA, 33 bp, Homo sapiens
gaggagaagttgagacaggcggtcaagcaggtg

SEQ ID NO: 1838 - DNA, 115 bp, Homo sapiens
aaccacctgatagtcgtggctggcttgctggccatagcagtgcagttgacttcaatctcctcaccttccaccgcagtgtctttctggatatcgatcatcagattacgtggtggga

SEQ ID NO: 1839 - DNA, 28 bp, Homo sapiens
tctctgtggctgatctggcgtccacacc

SEQ ID NO: 1840 - DNA, 71 bp, Homo sapiens
tctccagcaaatggggttgaaggagtccgagtggatcaggatgatgatcaagatagctcttccctgaagct

SEQ ID NO: 1841 - DNA, 225 bp, Homo sapiens
tcgggccctctgggctcgcactggcccacgtccgtccctggcgcctgcccccaagtctgggtggtgctggtggcttctcaggagagggagcttgggggcatcaggacgccagggcctgcagggccctgggccagcccccgggtccgggctgtggagagcggtcaggggagatccgcagagcacgggagcaggggagaggctgggatccggagcccgctacatcgg

SEQ ID NO: 1842 - DNA, 86 bp, Homo sapiens
ccagcaaccactgggaatagaagacaaggatgacagccagtccagccaagatgagctgcagagcaagcagtccaaaggcctggagg

SEQ ID NO: 1843 - DNA, 84 bp, Homo sapiens
gttcttgtattcaatgtcgaagcccgtgatgatgctgttcccgtcgaatcgctgggtccagcgcaggttcatgctccgggcctt

SEQ ID NO: 1844 - DNA, 84 bp, Homo sapiens
tagtcccctcaccatggaccagatccggccaaacacagaactaaaagaaaaaatccaacggtggcttgcagagaggaaacaaca

SEQ ID NO: 1845 - DNA, 1349 bp, Homo sapiens
ctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatg

SEQ ID NO: 1846 - DNA, 669 bp, Homo sapiens
gtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaa

SEQ ID NO: 1847 - DNA, 67 bp, Homo sapiens
acacagtggggctacggcccctgtgcgtgcccagggcccagccaggtactcggtactggagcacgga

SEQ ID NO: 1848 - DNA, 69 bp, Homo sapiens
tccagattatgagcccaacctctggatgtgggtaaatcccaacattgtgtatccccctggaaagctgga

SEQ ID NO: 1849 - DNA, 46 bp, Homo sapiens
tccaggttgcggagtccaacatcagcaggttcattgtggatgagca

SEQ ID NO: 1850 - DNA, 130 bp, Homo sapiens
accacagttcctgcttgccgctctcacagttcccagatctgctgagttgggttttttctgctccctcctccacccagcctcccaggctccctttatagccgccttctggacaatcattaagcctggggag

SEQ ID NO: 1851 - DNA, 39 bp, Homo sapiens
ctgcagagaaagttcccgcatctggagttcaggagtatt

SEQ ID NO: 1852 - DNA, 300 bp, Homo sapiens
ccacggtggcgctggtcttcttgggcagcagcacggcctggatgttgggcaggacgcctccctgggcgatcgtcacgccgcccagcagcttgttgagctcctcgtcgttgcggatggccagctgcaggtggcgggggatgattcgcgtcttcttgttgtcgcgggccgcattgcccgccagctccaggatctcagcggtgaggtactccagcactgccgccaggtacactggcgcgccggcgccaacgcgctcggcgtagtggcccttccgcagcagccggtgtacacggcccactggga

SEQ ID NO: 1853 - DNA, 360 bp, Homo sapiens
cggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatg

SEQ ID NO: 1854 - DNA, 70 bp, Homo sapiens
tgcctgactctctcccacctccgccgggggcccagaagggacctccccgggaaatcggcgccacccagcg

SEQ ID NO: 1855 - DNA, 163 bp, Homo sapiens
gccctacgagtggtacagcccacacccatgtgcccagggccggtgcaacctcctggtgaaccagtactccctgggcaacagcctctggtttccggtcggggggttcatgcagcaaggctccaccatcgcccctcgcgccttatccacccgctgtgtcagtggc

SEQ ID NO: 1856 - DNA, 101 bp, Homo sapiens
ccaacttgggcgatgtgaccgatttgagttcgaatgccaccaaccgaagacgtgtattcccaactggaagcgctgtgacggccaccaagattgccaggatg

SEQ ID NO: 1857 - DNA, 26 bp, Homo sapiens
tggctcagtacggccaccccagtccg

SEQ ID NO: 1858 - DNA, 24 bp, Homo sapiens
atctatgtagtcacagtgctgggg

SEQ ID NO: 1859 - DNA, 26 bp, Homo sapiens
cgggtagtatggactgtggcccacag

SEQ ID NO: 1860 - DNA, 31 bp, Homo sapiens
tggattttctcatccagccatccacaacctg

SEQ ID NO: 1861 - DNA, 92 bp, Homo sapiens
gtgtctactgtgcctacaggctcagccactctccctcccccagctcgcattctccaaatgcccctcacatgcacccattcttctaacctgaa

SEQ ID NO: 1862 - DNA, 25 bp, Homo sapiens
gtctctgagcctgtccgtacacagg

SEQ ID NO: 1863 - DNA, 40 bp, Homo sapiens
ggcctggtcaatggcccatacgcgctcatcaccactgctg

SEQ ID NO: 1864 - DNA, 92 bp, Homo sapiens
caggtcacaattgttgtgaactttgatctccctgtaaaacaaggagaggagccggactatgagacctacctccaccgcatagggcggacggg

SEQ ID NO: 1865 - DNA, 142 bp, Homo sapiens
accgtagggcttattgatgaccacaaggttcttgtcctggtggagaattcctcgggtcagtgccttagcaagcacgttggggtggactcgctgcagctgccgtgtgaaccgcactatttcttgcactctccgctgaacagcg

SEQ ID NO: 1866 - DNA, 39 bp, Homo sapiens
tggtgggagtactgtaatccaacacttctttgttagcac

SEQ ID NO: 1867 - DNA, 114 bp, Homo sapiens
agacgtcaaccgtgcggctgaggttggtgctgcccagggcgttggtcacctcacaggagacgggctctgagaagtacgtgtagtccactgtggtcctgtacacctctccagatg

SEQ ID NO: 1868 - DNA, 25 bp, Homo sapiens
actatcgtagctctctatgctttca

SEQ ID NO: 1869 - DNA, 57 bp, Homo sapiens
gcagcaggtttgcacagggtgccagttagggaggagaaggcagcgaggaaccccgca

SEQ ID NO: 1870 - DNA, 122 bp, Homo sapiens
tctcgcacgatccggccaagagatggcggggtggcgggaggggcgctctggcgaccccggaagcgagaagcaggcctctgcagggccagggatgaaggtgcaagggaaagccctgggacctg

SEQ ID NO: 1871 - DNA, 32 bp, Homo sapiens
ccgtgctgggacgcaccacatagtcagttctt

SEQ ID NO: 1872 - DNA, 175 bp, Homo sapiens
ttgatagcaggaattgccagcggagagggggcctgtgagagaggtgcgaccccttcagtactgcttagcggctcggccaggtcctctgcctctgatttgatcgtttttattttcttcttcttcttttcctctttttccttaaccttttttttaaggacagccaagtcatataagg

SEQ ID NO: 1873 - DNA, 142 bp, Homo sapiens
acaggcggcacttgaacgtgaagctgtcgtagtctgtggacgtgatgcggggcttgaacgtcttggagcggctgatgcggtcggctttcttggcctccctctcaggattatgcatcctctgcatgtgttcccgtagtttgtc

SEQ ID NO: 1874 - DNA, 26 bp, Homo sapiens
cgcgcgctagagcgacccggcgaggg

SEQ ID NO: 1875 - DNA, 85 bp, Homo sapiens
cacctggcccgagtggaagctatgctgaatgaccgccgtcggatggctctggagaactacctggctgccttgcagtctgacccgc

SEQ ID NO: 1876 - DNA, 63 bp, Homo sapiens
gctgtacagcggagtcccattcctgggcccctaccacaaggagtcggctgtgacggccttcag

SEQ ID NO: 1877 - DNA, 104 bp, Homo sapiens
atgcccggggcagttcacgtgccgcacggggcggtgtatccggaaggagctgcgctgtgatggctgggccgactgcaccgaccacagcgatgagctcaactgca

SEQ ID NO: 1878 - DNA, 90 bp, Homo sapiens
ctgccggcgtttcggggcgcgcctcggctgcctgcccggcggtctccgggtcctcgtccagaccggccaccggagcttgacctcctgcat

SEQ ID NO: 1879 - DNA, 240 bp, Homo sapiens
gtcgacccaggttaggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctgcaggcgcagcgcgcagacctgagcct

SEQ ID NO: 1880 - DNA, 101 bp, Homo sapiens
acagacgcgtgaggtttgggtacaggtaaaactgaattccttgggctgccccaggcaacgtcacccctcgaattaacaggaccaccagcatgaggtaagga

SEQ ID NO: 1881 - DNA, 89 bp, Homo sapiens
accagggtggtgtagtagtgagaggatggtccctgctccagcaccgccttcagccgcatggcgttggacatgaacagggccacgtccag

SEQ ID NO: 1882 - DNA, 774 bp, Homo sapiens
agatagagcttccctcccagtggaccctgcttagcaagttggaatgttcccacaagttccaaccctaaggatttcactccagggacagagtcaagtagattcttttgtaaatcattggccagaaaagagcacaaccactgctctttttcactattttacagctatttttgccgtcccctgaatgtacatcaatttccatgcagcaattggatgtctcagcctattggcttttcatagatgcaaactttcctttagggctttgtaaagaagttttgggaagttcttcaatagcagcagtttggggacatcacgtgtagccctgtcgatatttcctgaatggatttcattcctttctcagtcttgaccattcccttacccaacccccaccccaacacagtcaaaaccttttcgagcagcagctaggaaggtgagtggcctcccaccatgagcctcactttggggaatctatgctttagttggggcatattcttgccttagcctcatctctgcatttggcctcattctgctgctgcttctcagtacccagaagtccttgggttctaccagagaccactccgacagaaagggtcagaaacaactgaccctttcttggctgggtctggactctggagtacaggaagaactaaattattttgtcttggtccaagctgagctcacgctggcttcccgaagaggagacaggaaggttaggtcagaagtatgctcatgttgagacctagggcagatggtaccgggcaccatgaagcatcttga

SEQ ID NO: 1883 - DNA, 41 bp, Homo sapiens
cagcaggagtaggggcggcgaggctgaggtgtccgaggcgc

SEQ ID NO: 1884 - DNA, 84 bp, Homo sapiens
gaggctacgatttgaggaggttgagggggaagacaggagggaaagaaaagtcctacaactgtcaggaatggggcacctttccct

SEQ ID NO: 1885 - DNA, 27 bp, Homo sapiens
ggatgcgggggccccacatcattcagc

SEQ ID NO: 1886 - DNA, 51 bp, Homo sapiens
tgccacaccctctaacaggggcccaaggaaccaatttatcacccatgactg

SEQ ID NO: 1887 - DNA, 92 bp, Homo sapiens
agcaaacctgaggcctcccggcagacccacccaccccctggggctgctcagcctcaggcacggacagggcacatgataccaactgctgccca

SEQ ID NO: 1888 - DNA, 120 bp, Homo sapiens
gacacagacccaatccctgagcttcctgctggggtcctcagcctccttggactgtggcttctccatggcaccgggcttggacctcatcagtgtggagtggcgactgcagcacaagggcag

SEQ ID NO: 1889 - DNA, 34 bp, Homo sapiens
caggtgccggttcatgtcgttcttggccgtggcc

SEQ ID NO: 1890 - DNA, 235 bp, Homo sapiens
cgaccagatggtgccgggcatgaagcgggccgacgaggaataggtggtggaggtggaggtggaggacgacgagaggctggccgcggagggcgcgagggggccggccggggagcgcgcgggcgagcccagcacgcgcgccgaagggctgcagacagcggccggccgggcgcccagctgcagccccaggggccggatggggctgacgaagccggtctgcactgcctggtcgcgacga

SEQ ID NO: 1891 - DNA, 109 bp, Homo sapiens
cctccaggggcacaacacatgtccaggatccgctcatgttcctggggtgccaaggccatgacgggcaacatgctggaggctccctgcagcatgtagtgcccagccaggt

SEQ ID NO: 1892 - DNA, 371 bp, Homo sapiens
gctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaaga

SEQ ID NO: 1893 - DNA, 37 bp, Homo sapiens
tgatctttccctccgtcaaagtagtcaacagccaaac

SEQ ID NO: 1894 - DNA, 29 bp, Homo sapiens
ccgccatgttttcaagcccgaggccagct

SEQ ID NO: 1895 - DNA, 34 bp, Homo sapiens
gtgctgcagggggcgatatactcagcaaccacag

SEQ ID NO: 1896 - DNA, 30 bp, Homo sapiens
gaatcaaagccatcacacgccaccaggagg

SEQ ID NO: 1897 - DNA, 275 bp, Homo sapiens
aatactatcatgaagggaagaaccatatttgttctgctcttcaaccagagaaatatgtagttggaaaaatttgctatcttcaggaaatagaagatgctgaggctggtggcaaaccacatacttgattgattaccaattacccaaaagtaactaatatattcaattaggttaccggaggcatatatatttggagagaatatctgtataaatccatctgtaattattatccatatcagaaaaattcttgaaatagctaagccggtgagaataaagcc

SEQ ID NO: 1898 - DNA, 45 bp, Homo sapiens
agagtcggcacagggtggactgaggggcgtctcgcttttctgtcc

SEQ ID NO: 1899 - DNA, 37 bp, Homo sapiens
ccagtacaccagcagaggaaacttataacctcgggag

SEQ ID NO: 1900 - DNA, 25 bp, Homo sapiens
aggaacctaaagaagctctccctct

SEQ ID NO: 1901 - DNA, 28 bp, Homo sapiens
tacgggatgttagtggaaggctgtgagg

SEQ ID NO: 1902 - DNA, 24 bp, Homo sapiens
cctgttccttcaccacccaagaca

SEQ ID NO: 1903 - DNA, 45 bp, Homo sapiens
tagtggaagtacctcaaagcagcaatacgagtctggcctcttttt

SEQ ID NO: 1904 - DNA, 25 bp, Homo sapiens
aggtgtctgaagaaataagctccca

SEQ ID NO: 1905 - DNA, 130 bp, Homo sapiens
tggccaattacatccacgtccctcccggctccccggaggtgcccaagctgaacgtcaccgttcaggatcaggaggagcatcgctgccgggagggggccctgagcctcctgcaacacctgcggcctcactg

SEQ ID NO: 1906 - DNA, 103 bp, Homo sapiens
ttcctgccgcctgttgcgcatgattgccttgtattcaccaatgcgcagctttttgccatccaccaggcaggtgcgctttggcctgggcttgtacttatagtca

SEQ ID NO: 1907 - DNA, 337 bp, Homo sapiens
atggttaaacaattgcacgtgctcttcttttgtgagttctgtacccaaaataactttgtttacaaaaagagaaatctaaggcaaatagcaattttatccattgaataatactaaccatctgcttgttttctgcagggatttggaaggcaggagtggtaggacttgtgatttcatcaagcatctataattcaccaattctacagcaatacaaattttggatcctttttccatatagaaatgtgatgtcttcaccctctcatggaatagcagggaggttgcagagcaggcctcagggatttgagttctcttttgcttttctagtagctggttgagggtg

SEQ ID NO: 1908 - DNA, 440 bp, Homo sapiens
catccctccggagttgagcaaacaacgccacgccgcgtgcgctccggcagagcccagcactgacccccaaaggccgatttaaagaccctcggccgccagctcggaagcggatggcaacttagtttccgagcgaatggcgtttattgtccaccctagtccgagggctgcagtcaactaaaccacgaggtttcacaacggcgcccgaccctgcccgcgcctcgcgcccacgcggacgcaccgaccccggccgctgcgcggtggccaacgagtcgctttcctctcgggcctttcggccgccgggctcctttccgcgagagaacactgcggcggagaaaagtcattgtcaccttcaacgtggatccctcaactccggcgactcctcaattatgcccaggctccactcacttccccgccccgagactttcggtttgcctcaaata

SEQ ID NO: 1909 - DNA, 47 bp, Homo sapiens
cctccacccgcgtggccgggatggcagcgctcagctggttcaagtcc

SEQ ID NO: 1910 - DNA, 103 bp, Homo sapiens
accgccgcccgttccttcttccagggacacggcgagctggctgaaagcgtaaaggagcgagcagaagccgcaggccacacacagcaccacgacgcgcaggtag

SEQ ID NO: 1911 - DNA, 24 bp, Homo sapiens
aaatttgattcctaaaaggactca

SEQ ID NO: 1912 - DNA, 42 bp, Homo sapiens
agggttgtggcttcggcagtggtgcagcatccgcgcggctct

SEQ ID NO: 1913 - DNA, 94 bp, Homo sapiens
gggccacagcttcggccaactcctcctccatctcatgagttctcacgggctcgggctcgggcccggggaaccggtagaattgggcatctcggtc

SEQ ID NO: 1914 - DNA, 84 bp, Homo sapiens
ctgagtctgaaccgcccaacgcggcctcaacgtcgcggagccgtcgccatctttcccgtttcctggtcgcggagatgaacaccc

SEQ ID NO: 1915 - DNA, 29 bp, Homo sapiens
tggacaagcaggagttgtgagtccccaga

SEQ ID NO: 1916 - DNA, 64 bp, Homo sapiens
gaagagccctcatgtggcaaagacatggcctgggcagggcctggtgcagacagtagggaatgct

SEQ ID NO: 1917 - DNA, 45 bp, Homo sapiens
ctgcaccttgttgatgcggtgagctgcccggttatctttggcctt

SEQ ID NO: 1918 - DNA, 25 bp, Homo sapiens
ccagtggctgcgtggtgtctcccct

SEQ ID NO: 1919 - DNA, 24 bp, Homo sapiens
aggaagagctttgccatcccctgc

SEQ ID NO: 1920 - DNA, 27 bp, Homo sapiens
cggctccgggtgcggacaccgccagct

SEQ ID NO: 1921 - DNA, 30 bp, Homo sapiens
tccacaccaaaggccgaaagcatggcagga

SEQ ID NO: 1922 - DNA, 74 bp, Homo sapiens
cctccagttgtcggggtgggcacatgagagggtccgaggagctgccggctgccctagtattggggaaggtccag

SEQ ID NO: 1923 - DNA, 115 bp, Homo sapiens
tccctcatgcttgagtcccctggggccaccttgaggcagcctatcccaatgcatccccgccccgctatccgggtggggcgcagaagagaggggagcccttctccgctcagtctcc

SEQ ID NO: 1924 - DNA, 26 bp, Homo sapiens
gagcaaccgcacccagcttaaggttt

SEQ ID NO: 1925 - DNA, 133 bp, Homo sapiens
acacaaagcccagataagccacgctgaccacagcagccaccacatataatgccacatgccctaggtcccggacataaaccactacaaagtacatattgatggaacagatgataaggaccaagattcctcctgc

SEQ ID NO: 1926 - DNA, 73 bp, Homo sapiens
tgtgtggggctcggcagtcacccctggacattttgtcacccggaggctgcaacttggtcgctctggcctggct

SEQ ID NO: 1927 - DNA, 27 bp, Homo sapiens
ggtaccatggagacttgaagctggtct

SEQ ID NO: 1928 - DNA, 67 bp, Homo sapiens
cagccgaagcccagtccttcaggacaccaaagtctggcccttcctctctggcgataccaggagctca

SEQ ID NO: 1929 - DNA, 108 bp, Homo sapiens
ggaacgcgggcgctcctccagcttccgagtccagccagcctgggcgcggggcgccgcccccgagacacccgaggagtccgttcctccctggttacgtggactgtggag

SEQ ID NO: 1930 - DNA, 46 bp, Homo sapiens
gctggacgccgacccctccctccagcgggtgcgccaggaggagagc

SEQ ID NO: 1931 - DNA, 100 bp, Homo sapiens
gtcccacagactctgacatcatgtagccggccccattcatcctcgtaactgtccaccatcatgacgctgtcgtcctcacggcccagctcagcgttgaggt

SEQ ID NO: 1932 - DNA, 45 bp, Homo sapiens
cagcaagcaggccgagaatggcgagcgggcaggtagccctgatgt

SEQ ID NO: 1933 - DNA, 68 bp, Homo sapiens
atgcccaaccccaagccggtcggaggacccggcgggaagcatgcacctgcccctactgtaaagacagt

SEQ ID NO: 1934 - DNA, 24 bp, Homo sapiens
ggctgccttggcccatcctcaaga

SEQ ID NO: 1935 - DNA, 25 bp, Homo sapiens
ataaaaatagcctaggtctgaatac

SEQ ID NO: 1936 - DNA, 49 bp, Homo sapiens
gtgatcctagagagtgatccccagcaggtggtacaccgggtggcattaa

SEQ ID NO: 1937 - DNA, 325 bp, Homo sapiens
gatcttcctgtgagaattgccccaaatcagagtcttgctggaggaactgcttctcttctttcactttgtccatcacttccaacacaacttggtccaaactgttccttttgggggtgttgtggggtggtggtggccggtctcgggggcatgtgtacagacacatcttggagatggctttccgaaggcggtctctgggtgactggggttcaggctctcgggacagaatcctgatggatggcacatcagttggatggttgcaattccagaacatgtgggatggtgtgaacttttggacaggtgtcttagacacataggagtagagaca

SEQ ID NO: 1938 - DNA, 36 bp, Homo sapiens
gctcaatgaagacacgggctcgtgcagagactggat

SEQ ID NO: 1939 - DNA, 137 bp, Homo sapiens
tcgaggcgagtagacagcagcatccaggtttccggggagcccctcccaaagggcagacactcggaacaaggggcccggtcctgaatctgatacagtccacacatagtcccccttgaaagcataggtcttcccacggg

SEQ ID NO: 1940 - DNA, 48 bp, Homo sapiens
taagcgggactccagcgtgctgcggtgcgagccccaatcagacaccga

SEQ ID NO: 1941 - DNA, 101 bp, Homo sapiens
gagggctcgagtcttcttttctgccatctctcgctggcgcaacacctccagttctgcaaaatctgcactccgctcctgagctaagcgtccctgccctactc

SEQ ID NO: 1942 - DNA, 100 bp, Homo sapiens
ccaccgtagttgagccagcgatagtactgagagtagggaaagagcctccggtaataaagtttaagcagctcgggcagctcggtggggtcaaacgtctcca

SEQ ID NO: 1943 - DNA, 49 bp, Homo sapiens
gcggaactcgccacggtaaggattaccacaggaattggcgggaacagca

SEQ ID NO: 1944 - DNA, 120 bp, Homo sapiens
ggacggacgatgggcccaaaaagacaatcagcgtggccaggctggagaaagctgctcagacccgcaagactttaatcgagggcaaaatgacacaccccagggctattgtggtggatccac

SEQ ID NO: 1945 - DNA, 88 bp, Homo sapiens
gccatggcagtcgccactccctggccagcacggacgagaagcgagaactcctgggccggggccctgaggacgagataggggacccctt

SEQ ID NO: 1946 - DNA, 78 bp, Homo sapiens
gcagcaccacctcgacttctgcccccattgcccacttgctatgggcctctcaaagtgggaggcacaaaccccagctgt

SEQ ID NO: 1947 - DNA, 104 bp, Homo sapiens
gctcactgacccaaagatttgcaccgtgtgggtctgacctcatcatgtggagtgcagagggccctgatgacatgtgtgtgatgaggaccatgacccttgaaccc

SEQ ID NO: 1948 - DNA, 64 bp, Homo sapiens
ccacatgtccacaggtgttgcatatgtggactgcagaagaacttcgggagctcggtaccagagt

SEQ ID NO: 1949 - DNA, 50 bp, Homo sapiens
aaggcctgattgggctgttgcaggaaggaaacacaactgtattagtagag

SEQ ID NO: 1950 - DNA, 82 bp, Homo sapiens
ggtggaacacgcaagactcacggaataggcgggcccggaacaccccacaccggtccagcaggtctgtcacagggtcggcata

SEQ ID NO: 1951 - DNA, 119 bp, Homo sapiens
gcccttcttccctgcggagggagggcctgggcggtcgcgttggcgggagggaggttacctttcccagtctcgctctggccgcctgagccaggaggaagcagcggcgaggtctgcgggag

SEQ ID NO: 1952 - DNA, 34 bp, Homo sapiens
gggcgactcggctaatggcgtcggcgagtcttag

SEQ ID NO: 1953 - DNA, 248 bp, Homo sapiens
catgatggcatccaaaaggccaacgagctcttcagcattgatgaacttctgtgtgctgagggtgtacatcttctcatagaagtctgccatctccatccgagcctgaacaaagaagcagagctgctctgacaggtgggaaaggagttcttccacgtgaggagcagtcccacccagggcaccacggccagtcaccaccttcttcagctcattatgcaatgaagtatagatggtgcggatggaatccttcc

SEQ ID NO: 1954 - DNA, 99 bp, Homo sapiens
agctgaagggcgagaggccgaccagccgaaggaataaaaagccgtgccttgaaggccggtggctggagtcagacgttttctccctaggcgcgatcacgt

SEQ ID NO: 1955 - DNA, 26 bp, Homo sapiens
tgagccttccagtcttcagtagaaac

SEQ ID NO: 1956 - DNA, 162 bp, Homo sapiens
cgtatgtggtgttgtctatccgaaaggtagggcacaacgcggcccccagggtgtcactgctatagatgaggctaaagttacagggtgagcccaaaattctccactggatagacacagaatggctggaggccttggactccgccagggtgaagttacatctct

SEQ ID NO: 1957 - DNA, 51 bp, Homo sapiens
cctttttcgatcattcaatgcatagtgcattgccccttgggatatatttgg

SEQ ID NO: 1958 - DNA, 24 bp, Homo sapiens
gatgacaaaatatctggaggagta

SEQ ID NO: 1959 - DNA, 80 bp, Homo sapiens
atagcctctttccgagattccctgagctcctgtcttaattcttcatttcttccggtaagctgatcaacttgggctttcaa

SEQ ID NO: 1960 - DNA, 47 bp, Homo sapiens
tcccatgagcatgagagaagaagcaatgcacgctccggcagattcct

SEQ ID NO: 1961 - DNA, 319 bp, Homo sapiens
gcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatcca

SEQ ID NO: 1962 - DNA, 67 bp, Homo sapiens
gtgtgctgcctccgaaaagtttgcctcgtctccacaagtctgtctccttttttgtcaacctcaagta

SEQ ID NO: 1963 - DNA, 125 bp, Homo sapiens
tctggcgcacatcactatatttggctgcctctgccagtgctgaattctttgctgacattgccctggctcctatggaagctgctaaggttcgaattcaaacccagccaggttatgccaacactttg

SEQ ID NO: 1964 - DNA, 116 bp, Homo sapiens
ctatgactggggaactagtacacacctatgatgagcactcagagcaagtcaattgctgccatttcaccaacagtagtcatcatcttctcttagccactgggtcaagtgactgcttc

SEQ ID NO: 1965 - DNA, 24 bp, Homo sapiens
gccaaaggttctaccaaaactgcc

SEQ ID NO: 1966 - DNA, 28 bp, Homo sapiens
tttacaggacacccaggtgcctacttga

SEQ ID NO: 1967 - DNA, 73 bp, Homo sapiens
cggtggaccccgagttcacccacaaacccctcccagatggggcccgcccaacccggtaatcacgtctcaactt

SEQ ID NO: 1968 - DNA, 26 bp, Homo sapiens
ctgcagggtccctatcccggggcgcc

SEQ ID NO: 1969 - DNA, 25 bp, Homo sapiens
caataagaaagcacctttaaattga

SEQ ID NO: 1970 - DNA, 123 bp, Homo sapiens
ctcggccagaaaacctctcggtggcccgcttgactttgccgtaggtgcctttgcccagggtctcctgcagctcgtagcggtgcttcaagttgtgcttgtggtgatgccgcttcaccccgtgcg

SEQ ID NO: 1971 - DNA, 58 bp, Homo sapiens
atattgaatatacccgaggcagccagaggatcatccgcaatgccttacctatcggcag

SEQ ID NO: 1972 - DNA, 31 bp, Homo sapiens
tgtttgtggcttgatcgtcccccaggaagac

SEQ ID NO: 1973 - DNA, 114 bp, Homo sapiens
cacagggtcgtggcgaggattcaatgagataacgtttgcaaggcaatgggcaggcagtaagcactcaaatccgacaggagctactgtcacgaaaagcgggtttgcagccttggc

SEQ ID NO: 1974 - DNA, 25 bp, Homo sapiens
gatggaagccttccggcagaaggca

SEQ ID NO: 1975 - DNA, 24 bp, Homo sapiens
gctgctccggagccgtttcgacat

SEQ ID NO: 1976 - DNA, 47 bp, Homo sapiens
cccgcacacggctcgcggtctcggcgccgcggagatgcccggccagg

SEQ ID NO: 1977 - DNA, 130 bp, Homo sapiens
cctgtggcgtccagtgaggatgatcagaatggtcccgggggtaatgctggctcgcagttttctcacgtgctgactgaagggttttttgccgtggctcaacagctttcgaggcacatcttcagtaggataa

SEQ ID NO: 1978 - DNA, 125 bp, Homo sapiens
catcctggcctcgcagcgccgcaaggcgccccccgcgcccccgctgccgccgccgccgccacctggagggcctccaggcgcgcttgccgtgcgccccagcgccaccttcacaggcgccgcgctct

SEQ ID NO: 1979 - DNA, 145 bp, Homo sapiens
tgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaa

SEQ ID NO: 1980 - DNA, 93 bp, Homo sapiens
cgatgtccctacagtggaggcggctggagaagaagcctgggcgaagcagttgaaagctgcttgttcactggaggactcatcagaggtcccatt

SEQ ID NO: 1981 - DNA, 43 bp, Homo sapiens
tgaggaagtagacgagcgacagcccgaagaccagggcgagcac

SEQ ID NO: 1982 - DNA, 80 bp, Homo sapiens
cacagcctcatcacggccaacgtgccttaccagacggtaatgcgaaacgccgacctggacagcttcactactcacaggag

SEQ ID NO: 1983 - DNA, 32 bp, Homo sapiens
tcgtacgttcgcagggtgactccaaaaatatc

SEQ ID NO: 1984 - DNA, 42 bp, Homo sapiens
caatgaggacacgtagtggccggtctcgtcgaacaaagtcat

SEQ ID NO: 1985 - DNA, 148 bp, Homo sapiens
aaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttc

SEQ ID NO: 1986 - DNA, 149 bp, Homo sapiens
ctcctttctgcggctggatggcggggccagcaggctcatggcactgggctggtgctctggcgaccgcacgatggcggacatggcgatctgctgcctcgcggtggctggcgtggatgggtgtgggtggtccgttgctttgcggtgggcag

SEQ ID NO: 1987 - DNA, 187 bp, Homo sapiens
atacctccgaagcccatggctgctcccatgtggcagccaaggcctcctctgggcacgaagggctggctggtggcccctggggctccccaggctcttggagagctgtgctcccagcacagggtacagtgtggcagcggggagccccagagagctcacttgtgatggtcggcaggtgcctccaatctcg

SEQ ID NO: 1988 - DNA, 116 bp, Homo sapiens
gctacaggtgattgccgagccagagcacgagtatgaataggtgtgggtgtacgggttgtccagcagaaatttacagctgtccagcttcttggcctggtcatagcagttgtcatgtg

SEQ ID NO: 1989 - DNA, 29 bp, Homo sapiens
gcctgagagagcgggcctgccgtggccac

SEQ ID NO: 1990 - DNA, 104 bp, Homo sapiens
tcacggctgcggtgatcgagcacctggagcgtctagcgcttgtggacttcggcagccgcgaggcagtggcgcgactggagaaagctatcgccttcgccgaccgg

SEQ ID NO: 1991 - DNA, 89 bp, Homo sapiens
cacaccatggcacttgacccatagcaactgttgaaaaaccacaatggcacggttactaaataagcgaggcatagccttctccggcttag

SEQ ID NO: 1992 - DNA, 73 bp, Homo sapiens
ggtctggaaattccagggcctgactcttgatcttactgtgtaaacacatgatccgctcgtccatgaatgggca

SEQ ID NO: 1993 - DNA, 24 bp, Homo sapiens
aattatggtacatgaaaataatct

SEQ ID NO: 1994 - DNA, 72 bp, Homo sapiens
agctatttgggagtctgatgcataagaatagctttaacccaggaggcagaggtagcagggacccgagatcat

SEQ ID NO: 1995 - DNA, 103 bp, Homo sapiens
gagatcccgcatctgggcatcctttagtccctccacccactggacatccagggtccggagcagcggacaactggagctgcaaagggccgagaccgcgatccat

SEQ ID NO: 1996 - DNA, 108 bp, Homo sapiens
ctgtgcatgacgtgggctgccccatcgtccaggggtagcgagtcaggcggggggctgatggggggtggccggatcacatggcgctccatctggatacacttgggcggg

SEQ ID NO: 1997 - DNA, 24 bp, Homo sapiens
ctgaacagagactgcctcctctga

SEQ ID NO: 1998 - DNA, 24 bp, Homo sapiens
aagccatctccagtatccattctt

SEQ ID NO: 1999 - DNA, 127 bp, Homo sapiens
cctcatagacacctgcagggagtgcggggcccgggctctggagctcatggggcagctgcaggaccagcaggctctgcggcacatgcaggccagcctggtgcggacacccctgcagggcatccttcag

SEQ ID NO: 2000 - DNA, 28 bp, Homo sapiens
gcgccctgcgtccggcagaggaggcgag

SEQ ID NO: 2001 - DNA, 30 bp, Homo sapiens
gggcgtccccagctaacacccatccacgca

SEQ ID NO: 2002 - DNA, 126 bp, Homo sapiens
catcccggtacagcagcgggtacacagcactccgggagtgccctggctccgtcatgccctccggtggggacacaggttcaataccgtcctcaccaccacccaagaccgacgtcttgtttggctctg

SEQ ID NO: 2003 - DNA, 32 bp, Homo sapiens
agctcacagggctgacgggctccaccccttcg

SEQ ID NO: 2004 - DNA, 34 bp, Homo sapiens
ttctgtccagcgagaactctcattcagctccatg

SEQ ID NO: 2005 - DNA, 123 bp, Homo sapiens
attcccgggctggaactcagacagcagggagggcctccgccgctggggctggatgatggagccgggcgacaggtgggaggcatagtcgcgggagtggtgctggtactccaggagcccgacgtc

SEQ ID NO: 2006 - DNA, 87 bp, Homo sapiens
acccggccaggcatggcctccaccaagctcagcccttgggacaagagcagccactctgcccaccgcgtcgacctgtcagccgtgtga

SEQ ID NO: 2007 - DNA, 62 bp, Homo sapiens
ccgcggcccactcggcgcactcagccagcgtctcccctgtggagagtcggggctccagccag

SEQ ID NO: 2008 - DNA, 37 bp, Homo sapiens
catcaccctttcctcgatgccagcccctcggtcagga

SEQ ID NO: 2009 - DNA, 24 bp, Homo sapiens
agaacgacacattggatacagaag

SEQ ID NO: 2010 - DNA, 26 bp, Homo sapiens
gcacggacgcagaggcacccggggcc

SEQ ID NO: 2011 - DNA, 24 bp, Homo sapiens
accagctgtttattgaccacacac

SEQ ID NO: 2012 - DNA, 197 bp, Homo sapiens
gcacaatctgccacggaaggtccaggatgctgcgggcagttcttcgcaagaagctccccagccccgtggcaggaccatcccggatggccccgggcctgagcacaccctctgccgactccagacgctgcctcttcctgcgggcgaggcgctgccgggcctgcagctgccacttcttcttgtggaaccggagccagaca

SEQ ID NO: 2013 - DNA, 70 bp, Homo sapiens
gcaattgcaactccggctggagccccggacctgcaagcctgggtgtccgtgggtccgtctgcccagccat

SEQ ID NO: 2014 - DNA, 27 bp, Homo sapiens
ttagaatcccccactcggagtctaagc

SEQ ID NO: 2015 - DNA, 106 bp, Homo sapiens
attatggttactggtgatcatcccatcacagccaaagctattgccaagagtgtggggatcatttcagccaacagtgaaacagtggaagacattgcacatcgcctca

SEQ ID NO: 2016 - DNA, 25 bp, Homo sapiens
gaaactttgactgcctccaggttgg

SEQ ID NO: 2017 - DNA, 296 bp, Homo sapiens
actctgcggaccagcactttggaaaccgggatttttgttctgggcatctcactcctggagggttgctggtgcaccacgggatggctagatggaaggttggtcaggtgcttgatgctaatagggatcttagagtccttcagcaagctgcctggtgttcgcagtggacaggtgatggtgcctggagatacgggctttaaccgggacagggaggacgtctcctcgttgtccttccctccaggaagggttgctggacttccgtccgggtcagcatagagatcatagagcgcgtccccgct

SEQ ID NO: 2018 - DNA, 61 bp, Homo sapiens
tgtcccgggccacgtctgttggagaccagctggaggcacccgcccgcaccatttacctcaa

SEQ ID NO: 2019 - DNA, 34 bp, Homo sapiens
attcacatttgggaaacgaacaggagatgagcaa

SEQ ID NO: 2020 - DNA, 108 bp, Homo sapiens
aaggtagccaagggaaccacatggaagttgtgacagctcccagcggcgcgcccctttcgtgtgtgccggtacctcggcttaggagttgcccgctgacaccttgaatga

SEQ ID NO: 2021 - DNA, 102 bp, Homo sapiens
aagatctcaccgccagccatgatgctgctctcctagagatggaaaataaccacacagttgccatcacaatcctgcaggatgaccacgaccacaaagtccaag

SEQ ID NO: 2022 - DNA, 24 bp, Homo sapiens
aggcggcccactagaaggcggcag

SEQ ID NO: 2023 - DNA, 108 bp, Homo sapiens
cggagctaaaagaattacggcacaaagagcagaacccatatgtggttcaaagcattatcagcttaataatgggcatgaaattctttcgaattaagatgtatccagtgg

SEQ ID NO: 2024 - DNA, 126 bp, Homo sapiens
tcgtttaacgaccgcacagctccgaggtttggcctctatcgttatgctgcagatcagtttgagcccaaggcatccatgaaacattacaggaaaattattgacagcaatggtttcccgggcccagaa

SEQ ID NO: 2025 - DNA, 24 bp, Homo sapiens
ataagtgattacacctgctgccca

SEQ ID NO: 2026 - DNA, 113 bp, Homo sapiens
gtgccagcaaagtgtattctccatctggcctcagagcagatgccaagcctaattgggccacaagatccgtgaaggtggtttgctgttttccagccagctcaataacttgtttg

SEQ ID NO: 2027 - DNA, 24 bp, Homo sapiens
tcatgccatgctatttcttcgtct

SEQ ID NO: 2028 - DNA, 42 bp, Homo sapiens
taagatcacgctgacgtcggacccacggctgccgtacaaagt

SEQ ID NO: 2029 - DNA, 364 bp, Homo sapiens
gctctaggccgagaatggtatatacatacgatctatacagtgagatcgaaagacaatgccaatcgaggtattggcaaaagaagtgtggagtaccattctctggtgagtcaaggaaagccccaatccaccaccaagagccggaagaagagagagatcaggagcacaccctcactggcatgggagattggtgctgaaaacagtcgaggaacaaacatccagcacattgccctggaccgcaccaagaggcagatcccccatgggagagcacctccagatggcatcctcccctgggagctcaacagccccagctctgcagtcagcctggtcactgtggtgggaggcaccacggtagggttactcacca

SEQ ID NO: 2030 - DNA, 109 bp, Homo sapiens
gcgggtgctgcgacagcggcccgggcggcgggggctgcggtggcgctgggtgcaggcagcccgcctccgggccctggaagtccccgcacagccccccggtggcggccgc

SEQ ID NO: 2031 - DNA, 55 bp, Homo sapiens
ggggcaggaacactttgatggctgagtgcagggtcccctcggaggtcatcagatt

SEQ ID NO: 2032 - DNA, 140 bp, Homo sapiens
tgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctgga

SEQ ID NO: 2033 - DNA, 26 bp, Homo sapiens
tcactttaaatgatctcaagccagcc

SEQ ID NO: 2034 - DNA, 81 bp, Homo sapiens
tgaatctttacttgtgcagactccagctgtgcctcctggcccatgcctccctcccagattacagggtagacccaaagcaaa

SEQ ID NO: 2035 - DNA, 86 bp, Homo sapiens
caggactgaaagggcacagacaggtcactgccagcattgttggggcaagcctgcaagcacgcatcactggggatctgacatgacaa

SEQ ID NO: 2036 - DNA, 154 bp, Homo sapiens
ctggacaagccgagctacgatgcctcgagagagaagcgttgtagccgaggggcgatgtgagggattccttttaaacatctgcttgactaggaactgaagttcataggagtaatgagacggcagtggactgatgcacccttgacatactttgagg

SEQ ID NO: 2037 - DNA, 176 bp, Homo sapiens
agtggcaggaagccgcgctgcactcaggagctgcaaccgccttccccggagccccggaacccggacgctcgctcagccctgcgccccgccgccgccgccgccgccaccgccgccaccgccaccgccgccacctcctagagccgcgcggagccgagcggtgcgagcgcgccgctgtg

SEQ ID NO: 2038 - DNA, 85 bp, Homo sapiens
gttgtgacctgaaggtcccgtcttcactaccttgtacatgcctggccctcctcgcaagaatggcatatcttgttcttgcattgtt

SEQ ID NO: 2039 - DNA, 103 bp, Homo sapiens
tggcaccagtatctcgtccacactgtcctttattatttacaccaaatgtccacacctctccattcttcattaaaacacaagtgtgagctttgcccatagctac

SEQ ID NO: 2040 - DNA, 43 bp, Homo sapiens
gaaccaggtgttcaccctccaatacctccaaagcccagttctc

SEQ ID NO: 2041 - DNA, 61 bp, Homo sapiens
ggcgggaaagccaccacttgcggagccccgcctacagcgtcagcaccatcgagccccggga

SEQ ID NO: 2042 - DNA, 27 bp, Homo sapiens
tgtggtgatgttacttcccgggatttg

SEQ ID NO: 2043 - DNA, 29 bp, Homo sapiens
atctgatcgggctgaatttcaagagctcc

SEQ ID NO: 2044 - DNA, 44 bp, Homo sapiens
agcccgcggaccgacccctactcggcggcgcaactccacaacca

SEQ ID NO: 2045 - DNA, 67 bp, Homo sapiens
tgctatccgacgacctgtcgccgggcaccgcagcatcctcgctcgctccgatgggacgagggacgcc

SEQ ID NO: 2046 - DNA, 36 bp, Homo sapiens
gagtgtgctcctcggctgccatacgcgccagcttcc

SEQ ID NO: 2047 - DNA, 33 bp, Homo sapiens
cataggaccccgaggatccaaaggtgcagtggg

SEQ ID NO: 2048 - DNA, 56 bp, Homo sapiens
agcccccgggattgcaggaatcccccagaagattgccgtccaaccagggacagtgg

SEQ ID NO: 2049 - DNA, 26 bp, Homo sapiens
gctcctgcctggcgcggttcagcacc

SEQ ID NO: 2050 - DNA, 194 bp, Homo sapiens
ggtctcgactctgcagattgggctttgcagaggattcctgtttcccacctccccacccctctgacagagactgaggagaccacacacgttgacctcctcttcatagccagccatcatttccactccaacattctgctgcgggtgtcattctggaaaataattccttgctgttccttgctcctttcagatcacag

SEQ ID NO: 2051 - DNA, 28 bp, Homo sapiens
ctcccacagcatcgcttccctgacggag

SEQ ID NO: 2052 - DNA, 28 bp, Homo sapiens
ggcctgggccgcgcgtagtcctcaacat

SEQ ID NO: 2053 - DNA, 64 bp, Homo sapiens
gcgcgcgctgatccgcagccaggagctgggcgacgagaagatccagatcgtgagccagatggtg

SEQ ID NO: 2054 - DNA, 34 bp, Homo sapiens
ccgagccccggagcgagagcgagtgcctgagcaa

SEQ ID NO: 2055 - DNA, 58 bp, Homo sapiens
atcaggaacactgaagagccctcccaaaggatttgatacgactgccataaacaaaagc

SEQ ID NO: 2056 - DNA, 56 bp, Homo sapiens
ctgaaagtcattgaagcttactgcaccagcgccaaaacaaggcaaacactcaattc

SEQ ID NO: 2057 - DNA, 1770 bp, Homo sapiens
gcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaat

SEQ ID NO: 2058 - DNA, 29 bp, Homo sapiens
cctcgccctccatcgtgtggagccctcag

SEQ ID NO: 2059 - DNA, 60 bp, Homo sapiens
ggcctccaaagcaaacgacgttctggtgaggtggaagcgtgcgggctcctatcttctgga

SEQ ID NO: 2060 - DNA, 71 bp, Homo sapiens
ccctatagacctcacagtgaacatactcacaatgggctactggccaacatacacgcccatggaagtgcact

SEQ ID NO: 2061 - DNA, 334 bp, Homo sapiens
gaaataccgcccacgtttgccatgctgcacccagagtggccccgagcctccactccctcttaggaaactactgactcccaggcctgagcctctcctggcgtcttggcttcctcagaaggcctgtcaggtacagctcccacaacgccctcatcaggacctgagtctatacggcctgcgccaggtccaggacccagtggggaggccgggcctcgggaagccacacttctggcaccacacacagcagatgagtacagccattaggaccaggagcagcgtccgcagtgccagggccaagaagacagggccgccatagacaggaaagccctcggaggcc

SEQ ID NO: 2062 - DNA, 28 bp, Homo sapiens
gcgaagagcgggcgtcatctctcgggag

SEQ ID NO: 2063 - DNA, 74 bp, Homo sapiens
tctcatctgtagcaaaaagccgggctccacgttcctggcacattgttgccatcatctcctgtagcctcacatta

SEQ ID NO: 2064 - DNA, 25 bp, Homo sapiens
ggatggtggctttgcagcagtctcc

SEQ ID NO: 2065 - DNA, 54 bp, Homo sapiens
aaggaacagatatgattgctaggcaacagagtgaaggtgcatttcagagaactg

SEQ ID NO: 2066 - DNA, 38 bp, Homo sapiens
tgagtagaggggacggagaagggtgttctgttactgac

SEQ ID NO: 2067 - DNA, 48 bp, Homo sapiens
tcttgccttgttactccctttacatctggaaggtgtaaaaaccacttg

SEQ ID NO: 2068 - DNA, 240 bp, Homo sapiens
cactctcccaatgacccggaagtatcgacctcaaagatgccctttccgcttccgggtcccaacagcgttaggttttttttttgtttgtttgtttgttttgtttttttccaaccctctttcggatggacgggggaaagagagaaagaaaaacgagggaaaatcaacaaaatgtgcgatgcaaagagtcgattttcgcggggtttgtcaacttcgccactgccgcacgcgaatcgacgtcgt

SEQ ID NO: 2069 - DNA, 90 bp, Homo sapiens
aaagaagtgaaagcaggatctcggccaggcacagtggttcacacctgcaatcccagcactttgggaggctgaaccaggcggatcacccga

SEQ ID NO: 2070 - DNA, 25 bp, Homo sapiens
gagaggaaacccttcaccagcttcc

SEQ ID NO: 2071 - DNA, 25 bp, Homo sapiens
tatagatagggaccgtggactcggg

SEQ ID NO: 2072 - DNA, 98 bp, Homo sapiens
cagcgacggcgttggatgccagcagctcctggggggacattgcagtgacataagcgacattggcaaagacatacacaaatgtgaccagtgggatggag

SEQ ID NO: 2073 - DNA, 26 bp, Homo sapiens
gcaaaaggggtgaggcatgtccctcc

SEQ ID NO: 2074 - DNA, 181 bp, Homo sapiens
aggtactgcgttgtcccgaaaccactttagttgcccatgcttcaaggcatagcgtgtgtcaccaaaccactgaatgatctcaggccgaggtaaaccagtgatctgttctaacttttggtaatcctcacgccgtgcccactggcactgtaaaaaaaaggatttaaggatagccagctgctct

SEQ ID NO: 2075 - DNA, 158 bp, Homo sapiens
gttggcgggcacaatgccctgctggccgtgtagggagcagaggcaccagccgtccagtccaccagcgccctctctctgcaggacccgtaggacatcccctcggcggaaggacagctcctggggggactcagcggtgttgtcatacagtgcccgggcca

SEQ ID NO: 2076 - DNA, 40 bp, Homo sapiens
ggtggagagccgacaccgtctggaaggatgagcccttttt

SEQ ID NO: 2077 - DNA, 106 bp, Homo sapiens
cggactctgaggaccgtgcggccaggactctcggaggcaccgctgcctccactccagaagaagaggcgccggggcctgtttcactttcgccggccccggagcttca

SEQ ID NO: 2078 - DNA, 120 bp, Homo sapiens
aaagggcacggcaaggagagaacgagtgatgatgtgtagggttggggagagtgcagtgatgggagcacagaccagggtgggagatggagcttggggtctcaatagtctcccttctttgcc

SEQ ID NO: 2079 - DNA, 26 bp, Homo sapiens
atactcatccaagacagcaggcactg

SEQ ID NO: 2080 - DNA, 24 bp, Homo sapiens
caagcaggacttccgggaggacca

SEQ ID NO: 2081 - DNA, 76 bp, Homo sapiens
ccaccgaagttccaggtaacactgaatttctgggaagagagccatggctccagccatactccacagaatcttatca

SEQ ID NO: 2082 - DNA, 84 bp, Homo sapiens
cctgagggttatggtagggtcccactttgttgacatacagaataacagggtcgccggccttgtagtgtgtcacgccttccaccc

SEQ ID NO: 2083 - DNA, 115 bp, Homo sapiens
ggaccgcgtatgccagctgtgccacccgtcgccggtccacgccgccgcccacctgagcctggagactctgaccgctttcgtgcttcctttcgggctgatgctcggctgctacagc

SEQ ID NO: 2084 - DNA, 62 bp, Homo sapiens
agtccttctaagccgggagtctcaggcccggcttggggcagctcagccaatgaaggccggtt

SEQ ID NO: 2085 - DNA, 24 bp, Homo sapiens
atgcctctcctccgagggtgccca

SEQ ID NO: 2086 - DNA, 82 bp, Homo sapiens
cagccacgttgcccggcggtgttggtgaggctcgatgccggcgtgcacggcaagcgcgaattcggaacctggcgcccttgac

SEQ ID NO: 2087 - DNA, 124 bp, Homo sapiens
gttggcgtcctcgtggtctgggtctggatcttgcatctcgccactgtcgttctggcactctgccattgccatctctgcatcttggaccattgcttcttccatatcatccatgagcccactgttc

SEQ ID NO: 2088 - DNA, 29 bp, Homo sapiens
agcagccagtattcgggaaaggcagacag

SEQ ID NO: 2089 - DNA, 24 bp, Homo sapiens
ttggaagatgatatgtttgtatta

SEQ ID NO: 2090 - DNA, 71 bp, Homo sapiens
caatccttcgggtacattccgcagatacatccaggtagtatgttatggcacgggctgtcacctctaataca

SEQ ID NO: 2091 - DNA, 25 bp, Homo sapiens
tgcactttgctccagccttttcacc

SEQ ID NO: 2092 - DNA, 121 bp, Homo sapiens
tgccagtccattcccgaggggataagaaggagaccaaccatcacgatgagatggaggtggactacgccgaaaatgaggggagcagctccgaggacgaggacactgagagctcgtcggtctc

SEQ ID NO: 2093 - DNA, 95 bp, Homo sapiens
agctggccggtcttcccgtgcacaccccgatggaggggcgagtcggcgctggggttagaggcgccagaggggtccttgcggctctcagggccgcc

SEQ ID NO: 2094 - DNA, 116 bp, Homo sapiens
tggcattggaaatctggagtgaagaatttcctgtgcatcatccactggggcttgcagaaggtggcggaaattttcatactcaggcatatcctggtatcctgacttccgccactgtg

SEQ ID NO: 2095 - DNA, 100 bp, Homo sapiens
ggataagaattcccggtccgacagaaagaggtctatatcagagagtagtcgatcaggcaaaagatcttcaagaagtgaaagagaccgaaaatcagacagg

SEQ ID NO: 2096 - DNA, 56 bp, Homo sapiens
ttcaccaaatttgtagatgaggggaaagccactgttcggttaaaggagcctcctgt

SEQ ID NO: 2097 - DNA, 260 bp, Homo sapiens
ggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccag

SEQ ID NO: 2098 - DNA, 29 bp, Homo sapiens
ggtctctgagcagcgactcacctgtgcag

SEQ ID NO: 2099 - DNA, 32 bp, Homo sapiens
ggcggccccgtctttgttgagcgcggagcccg

SEQ ID NO: 2100 - DNA, 31 bp, Homo sapiens
taggcgtcgcagtggacctcaggtgctgcat

SEQ ID NO: 2101 - DNA, 119 bp, Homo sapiens
tgggcagacggaacccgcgccagtaccagatcccctctcggaacgtcccttccgcccgcctgggcctcttgggcaccagtggattcgtcagctccaaccagcgcaacaccacagctacc

SEQ ID NO: 2102 - DNA, 33 bp, Homo sapiens
cgccagcagccgtccggagccagccaacgagcg

SEQ ID NO: 2103 - DNA, 92 bp, Homo sapiens
agtagcaggtttgttggcagatgctcgttctttagcagacatagcaagagaagaagcttccaacttcagatctaactttggctacaacattc

SEQ ID NO: 2104 - DNA, 335 bp, Homo sapiens
ttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgctcggtgttccgccattgggacaggggagtcccctaaggaaagcgctcagctctcaggggcctctccaaaagagagtcctagcagaggccctgccccgccgcaggagaacaaagttgta

SEQ ID NO: 2105 - DNA, 561 bp, Homo sapiens
ggatctggacaatgccatactggttaatttgcactggtgtagtaaaagtcactacagaccctccatcttgggaagccactgtttgaatgccttctcttttcacctcagtgctgggtatcaggcctgggaatgagacagggacactggggctgtaggacgtggtggttgctgagttagcagaactctggaggactttgaattccttcacgtcctgggaagtagaccccagtatgtcagtcatggatataccattgctcacaatgtttgatgacatttttggtgggttcaatgccactgcctgtgtatttcccacatttaatccattaaggataactccactgggtccctgaataaaagaatttccattaaggaagacaggtgaagtacttgcaggtaccaagcttccattcaacagaactccagaagagcttaatgatatcttagcatttccaatttgttgcatatatactggctccatatgactggaaaggctgaggttggtgatgccatcagatgaactggagagtgggtgaggagataaatcctcatgtcccttgctgg

SEQ ID NO: 2106 - DNA, 56 bp, Homo sapiens
aagggccgggctcaaagctccgcctctggcgcgaccgacgactggagcgcagggca

SEQ ID NO: 2107 - DNA, 37 bp, Homo sapiens
ggccgcccgccgtgaagacatcgcggggaccgattca

SEQ ID NO: 2108 - DNA, 144 bp, Homo sapiens
catcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccag

SEQ ID NO: 2109 - DNA, 28 bp, Homo sapiens
gatggtggagatgtgcgaggagtggaac

SEQ ID NO: 2110 - DNA, 89 bp, Homo sapiens
ctttgctggtggagtgtgtagaacaaatgtgcagcttcctggcaaggtagtggtgatcactggcgccaacacgggcattggcaaggaga

SEQ ID NO: 2111 - DNA, 26 bp, Homo sapiens
tgcagcctggtggacaatttcttgga

SEQ ID NO: 2112 - DNA, 69 bp, Homo sapiens
tgttgcatggcatgcatggtgttctcgggcacccggttctccagccacgggattgtgcggcggatccac

SEQ ID NO: 2113 - DNA, 24 bp, Homo sapiens
catcatggaggataacttgctcat

SEQ ID NO: 2114 - DNA, 24 bp, Homo sapiens
tcatttgaaccaagaaggcagaag

SEQ ID NO: 2115 - DNA, 89 bp, Homo sapiens
aggctgtgcaaggggagcagtcctcccctttgtaggtgccatttcccagagctcctggaattgtttcttcagttgtggcagctgtgtag

SEQ ID NO: 2116 - DNA, 50 bp, Homo sapiens
gagagcgacgccagggccaagactacagaggcggatgaccccttcaagga

SEQ ID NO: 2117 - DNA, 195 bp, Homo sapiens
ctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcgg

SEQ ID NO: 2118 - DNA, 51 bp, Homo sapiens
aagtggaaatgtggagattctgatggggtacttaaaccattagctttctca

SEQ ID NO: 2119 - DNA, 87 bp, Homo sapiens
ctgaatgggcgggtagcaactggggtcctcgccgccgggctggcagcggctggagaaggcgctgcgcggggtcacgtagttgctggg

SEQ ID NO: 2120 - DNA, 1130 bp, Homo sapiens
gataggatttcagcacaacgggccctttccagtcatgacagacagagatgtccaggctcttgaggagaaacaaaagttcctttgacttctcttgcaaggaccaaagagataaattttttctttacgatctgttgaaatatttatatagacttttaaaaacaactaacagttcatcctgtgctcagtttccctggaaggtttctcatgatcgcccctccgagagctagaggggttgtgtgtctgggaacaaaggattaagacactttaaaataagcaatgaaaatcctagtgcgacactcagaagcagatggtgggcttgagggggccgaggggtgggaggcagatgcttcgattgaggagctgggtgccgccttttgggaaagccgagtggagacagaagcatcgggacaggaagccctgctggagaaggctcagttccttccttgctgttccctgggggaccagggacagcacggcccctgcatttctacttctcagggccgaagacccgacctctgaccctccacccactccggtgacctgcacgctaagttgggtggtctctgactaaaacaggcttaagccaagaattgggactcgactcccaggagacctagggagaattcccttcaggctgtttcaggcaggaaggaccagggaggctcactccccaggcagctgacaggcatggagggaagagccaaggacaggagaggcttccaaggctccaagagcagcagaggaaggggccagccacgtggtggccatggacctggctcggctcatgaggaagacgtgctgccactgccacctcaccctgtgcggaggagactgtgcgaagtcttcacagccagcagcagcctcgatacgccccgagtgcctttcatatgtatatatgagagagagatatacacatatatattcattatttttaactgaaataaatgcaacggattcaggttcattcccctttgcgataagttgcaaggtcccctgccctgaggggtccacaccttcgggcctgccgccaggctcacccccactgagggaaagtggccctggatgcggagaggagaggacacacaccacagcaggtgactgggaggagggcctacctcgcaagactgttt

SEQ ID NO: 2121 - DNA, 104 bp, Homo sapiens
cagacaccttgagttccttggtttggtccacgtcccatgaacatgcagcagagctagttagcatggatgaggaaaaatttgtggatgccgttaactctgccttt

SEQ ID NO: 2122 - DNA, 145 bp, Homo sapiens
tacgcaggccatgtgggccgcatccagctggaagccctcaaaacagtcacaggtgtagccctcccgcacgcgcacacagcggccattctcacagccgttcaggatgccgcactcctccgcctgaagcccttcgaagccggctggg

SEQ ID NO: 2123 - DNA, 74 bp, Homo sapiens
cagccgctgccgggtagctgcccccagggcgccgcagtcgattcgcgtctccaccagccggctcgtatctccct

SEQ ID NO: 2124 - DNA, 93 bp, Homo sapiens
gaatcattcctttggtgaaacgatagggatacaagatgttgtgaattttaactgctaagctctcagcctggccactgcttacatcaacagcaa

SEQ ID NO: 2125 - DNA, 74 bp, Homo sapiens
ctgcacgcacacgcaggaggagtcagtggtgttcccttcccagcacaggttactgcaggattcagccgaggtga

SEQ ID NO: 2126 - DNA, 105 bp, Homo sapiens
gttccagagcttcgatgacacccctctggggacggcctccctggcccaggtccacaaggcagtgctgcatgatgggcggacggtggccgtgaaggtccagcaccc

SEQ ID NO: 2127 - DNA, 202 bp, Homo sapiens
tcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaac

SEQ ID NO: 2128 - DNA, 25 bp, Homo sapiens
cagtaaccagatatggagattgcaa

SEQ ID NO: 2129 - DNA, 108 bp, Homo sapiens
cagatatagattccagtgatgagagtgatattgaggaagatattgaccagccatcagctcataagacgaagcatgacttgatgatgaaaggtgaaggcagtcgtaaag

SEQ ID NO: 2130 - DNA, 120 bp, Homo sapiens
atggcccaccagaggccagtcaagatctggcagagtgctgtcgcgcctttggtgggaaagatattaaagtgtacatgccaaagctacatgaaacagttgatgccactagtgaaactcaca

SEQ ID NO: 2131 - DNA, 25 bp, Homo sapiens
gctcttctgctctgcgccgggcaag

SEQ ID NO: 2132 - DNA, 145 bp, Homo sapiens
caatgacggcgtgctgccctgtctggttgttgatgatgatgtcgatgccgaagagtgacacgcccagtgcctgccgcagggcccgggagagctcccggatgacctcgtcgctcggccgctcgaacacgccctcgatcttgtccag

SEQ ID NO: 2133 - DNA, 127 bp, Homo sapiens
gggaacacatgacatgatttgtgaatatcatcatctttgccagacaagtctccaggggatccctgtttcccaactgaaaggtgtgaacggacacacacacagcctggatgacgccttggctgttcta

SEQ ID NO: 2134 - DNA, 24 bp, Homo sapiens
cagcgaggagccaactatcccaaa

SEQ ID NO: 2135 - DNA, 70 bp, Homo sapiens
cattggccggggacacacagtagattggagcacagaggccaacagcaaagagtactccataaaggtaaga

SEQ ID NO: 2136 - DNA, 28 bp, Homo sapiens
tgatgactttccacacggaaacaggaag

SEQ ID NO: 2137 - DNA, 826 bp, Homo sapiens
aactgcgctcgatctggattccagtgatcctctgcagtgcccacctgcctccagggagcgactgaagaagccgactgccgggggaacacctggattcatgaaccaaagcagcctcaagtttcatgttgtcaaggcagggtatcagaatctttctgagggcaaagtattattaacaaataaaaatatcagtattttaaaagacaattacaggagtgttagaggtcattctaaatttcatcacttcacgtaatataaaagaaaaaagaaaagaaatataacaaacattttaaaaacataattaagagttcagttaacaaatctgtttcatactttcacaaacagtaaaaatgccacagacaaaaatgacctatttaagttgtgcgagtatatgacacattgcaggcattataattatctttttcaaattccataaatcaaaacagcagcaaggccaaaccacatttttttcctctctgttaagcatattttcttgaaatgaggtaaagcatggtaccaagtgcaatgcttatctgtgctacatgaacagaacagaagggaaaaagctattataaaacgcagcatagttaggactgcggaaagcatattataaaagaaattttaaaaaatttacaaatgaaggttcatgttaactaacttgcacacaatcatcataaggaatttctgcagttgctttttcaagacacgcctccccagtcctttacacacgtgctcagggcacaaccacaccccactggtaggttttccatattacattcggtctcacattgcaatcacaggaacacagggtggcacacagggctctaaa

SEQ ID NO: 2138 - DNA, 121 bp, Homo sapiens
ggtggtcttcctcaaggggacgccggagcagccccagtgcggcttcagcaacgccgtggtgcagatcctgcggctgcacggcgtccgcgattacgcggcctacaacgtgctggacgacccg

SEQ ID NO: 2139 - DNA, 26 bp, Homo sapiens
tgggcgtggtgtatgccttcaccttc

SEQ ID NO: 2140 - DNA, 54 bp, Homo sapiens
ggagcaggccacactcaagccactggaccccgtgctgtgcaccctgcggccccg

SEQ ID NO: 2141 - DNA, 65 bp, Homo sapiens
tggaggaaccaatctctgtgctgtggatgactccaacgaccatgtgctctctgtatgggactggc

SEQ ID NO: 2142 - DNA, 39 bp, Homo sapiens
cttgtattcacaggaaggcagtgggagattgactgccaa

SEQ ID NO: 2143 - DNA, 99 bp, Homo sapiens
ccttgcacccgagagagcccgtgttcctggcacagaccaatggcaactacctggcccttttctccactgtgtggccctaccggatgagcagacggcggc

SEQ ID NO: 2144 - DNA, 108 bp, Homo sapiens
cccctttgtgaccagtgcgtgacctctcccggctgccttcacggactctgtggagaacccgggcagtgcatttgcaccgacggctgggacggggagctctgtgataga

SEQ ID NO: 2145 - DNA, 24 bp, Homo sapiens
tcctgcccgaagcctcaggaggtc

SEQ ID NO: 2146 - DNA, 39 bp, Homo sapiens
gccgggagctgtacttctatatctacaagggggtccgca

SEQ ID NO: 2147 - DNA, 74 bp, Homo sapiens
tgccctgcctccggtgccggtggatgggggagggactggcctctgactgcggggttgcaccatggcggcggtcg

SEQ ID NO: 2148 - DNA, 101 bp, Homo sapiens
gccggaccacgcggtgctgcttctccagcccccgcagccgctgcgtggagtcctcacgctcttggcgaagcgccactgtgtcctcaagctgtcgctcgagc

SEQ ID NO: 2149 - DNA, 31 bp, Homo sapiens
gccaaggccgagagcatcacgctggacttgg

SEQ ID NO: 2150 - DNA, 88 bp, Homo sapiens
catttctgggcaggcatgaggtcgtcgatggcctggccctgctccagccgctgctccatctcgatgagcagcttcactccgtccacca

SEQ ID NO: 2151 - DNA, 34 bp, Homo sapiens
ttctgggattcaggtccagtagatccaaatccat

SEQ ID NO: 2152 - DNA, 39 bp, Homo sapiens
ttttgcaatgcctttccggcagcatctcgatggatatag

SEQ ID NO: 2153 - DNA, 119 bp, Homo sapiens
gtcggccgagtacctggcggccctggagcgagccacggcggccctggagcagtgcgtgaacctgtgcaaggcgcacgtcatgatggtcacctgcttcgacatcagcgttgcagccagtg

SEQ ID NO: 2154 - DNA, 25 bp, Homo sapiens
ctggaacagccctcgcaagcagcag

SEQ ID NO: 2155 - DNA, 65 bp, Homo sapiens
tgcaggagatcccgtgggcagcacgcgctgtcccgcctctgagcccggccttgatgctacaacag

SEQ ID NO: 2156 - DNA, 103 bp, Homo sapiens
agcctcacgttggtccacatcctgcggccgctccttgtagccaatgaaggtgccatcattcttgaggaggaagtagcgtggccgccaggtcttgatgtactcc

SEQ ID NO: 2157 - DNA, 224 bp, Homo sapiens
aagaatttctgctggctcctcatctgaacagctgtctgcaagctggtggccagaaggaacttcaaatgtgagtgtttgctgtcccagtacattgacgctggaagagatcatctcaaatggttctccagtgtcaggctggagatctccagaaatggagtctactcctggggtggcttgtatgggagcctcttctgtgccctcctgagtcctagagtgttgagtca

SEQ ID NO: 2158 - DNA, 31 bp, Homo sapiens
gtgagtgcaagtacgaccctcccagccgtcc

SEQ ID NO: 2159 - DNA, 36 bp, Homo sapiens
ctcctcttccgtgtgctctcgccactccctgcgggc

SEQ ID NO: 2160 - DNA, 45 bp, Homo sapiens
atgcgacgaccacgttcccatcttggggggtgctgtcgaggctca

SEQ ID NO: 2161 - DNA, 121 bp, Homo sapiens
aggggctggcgcatcttcctgcacacagaagagtccagggtgggtcctttctgctctctggtagccacagatgaggtacagaggctgcttcccttctctgcaggtacagggcgtcctgctc

SEQ ID NO: 2162 - DNA, 31 bp, Homo sapiens
gcccaccacacaatgtctgttaaataggaag

SEQ ID NO: 2163 - DNA, 31 bp, Homo sapiens
gggcactgctgggcgttcttcatcccacaaa

SEQ ID NO: 2164 - DNA, 63 bp, Homo sapiens
aaactcctggatcaatctagactcctgcctcagcctcccaagtgcctgttagtacaggcttga

SEQ ID NO: 2165 - DNA, 80 bp, Homo sapiens
ctccatcctggacggcgaaacgacctcgggagaccccggttaggaccttactccagggatcaactggaatcaaaatccaa

SEQ ID NO: 2166 - DNA, 146 bp, Homo sapiens
tcccatcagccgtcacagcaaagagggtctgttcccctccgattaactgcacgggtctgagagttgcaagggcttcacagggagtgggaactttgacttttgcgccttcaatgcccccgagctggcccctgtgattatgtccccat

SEQ ID NO: 2167 - DNA, 24 bp, Homo sapiens
tcaagaaatcagctcgttttttgt

SEQ ID NO: 2168 - DNA, 24 bp, Homo sapiens
ttttgtcatgttcactgaattgat

SEQ ID NO: 2169 - DNA, 190 bp, Homo sapiens
catgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaa

SEQ ID NO: 2170 - DNA, 129 bp, Homo sapiens
acgtgctggccgacgcaccagactcctccttgctgcccttgcgcgacttggccttcttctccttgccccgctcggccgagtccccgttcttgccattggcggagttggcgcggcccatcttgccgtgca

SEQ ID NO: 2171 - DNA, 87 bp, Homo sapiens
gcattgccgggaccggatatgagcatgaaacctagtgccgccccgtctccatcccctgcacttccctttctcccaccaacttctgac

SEQ ID NO: 2172 - DNA, 60 bp, Homo sapiens
tgcaaaaaggtgtcctgccccatcatgccctgctccaatgccacagttcctgatggagaa

SEQ ID NO: 2173 - DNA, 248 bp, Homo sapiens
cagcccactcgacaggaatggaaacacagaaggaggcattcgatggtcaaggagggcgctctccgctcccgctgcctccttcaaccgcgggtcctccgcccctcgagggctagggcatccctctccagtcccctcgggctgacgcactcgacccctctccttagcgggaggagaacgtttggccgaagctatttttcagtcctgttggcttcgaggctggatggcgatgtgaagccaacgtaatgccc

SEQ ID NO: 2174 - DNA, 35 bp, Homo sapiens
tcgggggctggacgcccagactcgattgggaagga

SEQ ID NO: 2175 - DNA, 70 bp, Homo sapiens
gcacgcgcccgtccacgccctcagggccctcgcccggcgcggctccggcgctctcctcgcggggcaggct

SEQ ID NO: 2176 - DNA, 601 bp, Homo sapiens
ggctggagcccgaaggtatttctccagatccacagggagaggtctcaccctccagctgtggatgttaaaccctgccagatgtcccagccttgatctgtctgctcctactcctcacatctggaggattccagcaggaggggttttggaggggacctgcttgcgacctgctgagggcttgtctgctcccacagcaccatctaagacccctcctctagaagtggggaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattctccaaatccagccatagatggctgctgggtgtgcagcaggagaaggaggatggtcagccttggagcatctctcaattacgggacag

SEQ ID NO: 2177 - DNA, 29 bp, Homo sapiens
ggaacctgggcgtattgggcatcacagcc

SEQ ID NO: 2178 - DNA, 80 bp, Homo sapiens
tctgtgaacgtggctcccgaggaggccgtgaagtagacagagctggagccagtggagtcactcctctcccggacaaacgg

SEQ ID NO: 2179 - DNA, 26 bp, Homo sapiens
gtggcccagggagcactaattccaag

SEQ ID NO: 2180 - DNA, 32 bp, Homo sapiens
tctgaggccggctgagtctccggagtttcttg

SEQ ID NO: 2181 - DNA, 100 bp, Homo sapiens
cgtgcggatctcgggcagccatttctctgtgatgttttgaaaggagctgggctgcaccacgctgaagcacgccaggaagacatcggtatccgggtagcaa

SEQ ID NO: 2182 - DNA, 481 bp, Homo sapiens
accacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgtt

SEQ ID NO: 2183 - DNA, 72 bp, Homo sapiens
atggtgttctgaattggggtcccggttagcaaaagccgattccgacactggaactgtaagaggatcttccaa

SEQ ID NO: 2184 - DNA, 98 bp, Homo sapiens
atcccacaacaaggaacggcgttccaagcgggatgagaaactagacaagaaatctcaagccatggaggagctaaaagcagagcgagaaaaacgaaaga

SEQ ID NO: 2185 - DNA, 233 bp, Homo sapiens
gtccccaaagagcgggtaaatagctaagccactcttcactcccagtacagaccttcagaagccccagatatcaggatgtaatggtagggctcactgctctaaaacagctcaaacaacctgctcccaggaaggcaagccttctgctccttggtctcctgcctaccattaggacacaatgttcttcgtctggccagacatctgttgaaaggctggatacaggacaacgtacccat

SEQ ID NO: 2186 - DNA, 168 bp, Homo sapiens
cgcgctgctgacggcggcgaccgcggccggaggcgggcgcgggtctcggaggcggtcgcctcagcaccgccccacgggcggccccagcccctcccgcagccctcctccctcccgctcccttcccgccgcctcctccccgccctcctccctcctcgctcgcgggccggg

SEQ ID NO: 2187 - DNA, 738 bp, Homo sapiens
tgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtg

SEQ ID NO: 2188 - DNA, 37 bp, Homo sapiens
cgtgcggagcgagttacgagaattcccggccgctgca

SEQ ID NO: 2189 - DNA, 81 bp, Homo sapiens
tgtgtgtttcctgccgtggcggccccgcagcctctcacaccgggctcccgtgaggtcaaggagggctatggaagctacttt

SEQ ID NO: 2190 - DNA, 24 bp, Homo sapiens
attcccttggctggtgctggtcct

SEQ ID NO: 2191 - DNA, 70 bp, Homo sapiens
acaaacccttgtccctttgccatgtggaggaaagtgcctgcctctggtccgagccgcctcggttctgaag

SEQ ID NO: 2192 - DNA, 95 bp, Homo sapiens
agagagttgcccaaaggtagacggcagctctctaaggtgattgttgtttaggcttagcgtctctagttttttcagattgcatatctcatcaggca

SEQ ID NO: 2193 - DNA, 26 bp, Homo sapiens
tttatctcggagatgaggtgggaggg

SEQ ID NO: 2194 - DNA, 66 bp, Homo sapiens
agctggacttagttcagggtcgctgtccttggcagtcaccatcctccgggcagtgaggagctgaaa

SEQ ID NO: 2195 - DNA, 99 bp, Homo sapiens
tgcatacaggtaagaatcttcaaaaaagatcgaaaaccttcaaggaactgcattcttaatctttctgtccatattgtgggtttgctgatcaggatatac

SEQ ID NO: 2196 - DNA, 90 bp, Homo sapiens
atggcagtggtatgcaactgggcctctgcgagctcacagtcaagagctctttgtaggctgtatatgacgtggtcatatgaatggtgttca

SEQ ID NO: 2197 - DNA, 26 bp, Homo sapiens
cctcggtggccttggaaagcaatcac

SEQ ID NO: 2198 - DNA, 33 bp, Homo sapiens
ttgatggcagcgacggtgattcccgaaacttga

SEQ ID NO: 2199 - DNA, 65 bp, Homo sapiens
cttcttcacgctctctttgagtttcttttgtagcttcttgtgttctcggccccggaaataggcca

SEQ ID NO: 2200 - DNA, 143 bp, Homo sapiens
agtacggtgcggttgtggagcgacggcaggccggctatgccccgcgtggctgcgttgctgagccggcgcgggttgggcagctgcggctcctccagagcctgatacacaccgtcggcgtaattggctggtacgcggcgctgcaa

SEQ ID NO: 2201 - DNA, 34 bp, Homo sapiens
ttgggaaactgtggaccctactgtacctcaaaag

SEQ ID NO: 2202 - DNA, 24 bp, Homo sapiens
tctggaagtgttagttgcaaagat

SEQ ID NO: 2203 - DNA, 190 bp, Homo sapiens
aatgtgtcttttccagccctgatgttgggggtggatttttagctcgcatattttttccagatgtgataagctctccatagccttcttggtgagcaaaagcatagccagaccttcttgagcttgacctgcgggtccgaggccttcggctacttggaggccttgccttcttttgagccttctgccaccggcg

SEQ ID NO: 2204 - DNA, 43 bp, Homo sapiens
tggataccagtttaccaagcaagggccacgaacaagggtggca

SEQ ID NO: 2205 - DNA, 127 bp, Homo sapiens
acacgaaggtgtttccagtttctgagggggccaggtccaagcagaggacgtcagccccatgtccgtggaagctctgcagcagctgcccgctctccacgtcccacagggcacatgtgccatcgccgct

SEQ ID NO: 2206 - DNA, 26 bp, Homo sapiens
tttgtgtagagctccgacgcagccat

SEQ ID NO: 2207 - DNA, 53 bp, Homo sapiens
tagcaacaagggacggcttccgttgaggaaggtcttgcggagtgggaatgtgg

SEQ ID NO: 2208 - DNA, 24 bp, Homo sapiens
atactcattaacccacctgaaaac

SEQ ID NO: 2209 - DNA, 34 bp, Homo sapiens
ccaggagcccgaacacctccaccgcgcaagttgc

SEQ ID NO: 2210 - DNA, 43 bp, Homo sapiens
tgctgcgctccacgtccacggtcaccctgctctcgggcggcgc

SEQ ID NO: 2211 - DNA, 33 bp, Homo sapiens
tgcagaaggcctccgggtagcaaccaacgcagc

SEQ ID NO: 2212 - DNA, 49 bp, Homo sapiens
agagttggatcgtgcccaggagcgtctggcaacagctttgcagaagctg

SEQ ID NO: 2213 - DNA, 85 bp, Homo sapiens
tgccctgcattcggctgctggaggatcccaccctgactgtgtgcagctcctcctcagggctgggagcaccgtgaatgccctcacc

SEQ ID NO: 2214 - DNA, 1092 bp, Homo sapiens
aggccctagggttggacaagaagccagttctaggctccaggttaatcacggagatcacaaccccctggatctgctcactaggcaagaacctctcactccggtaggccctcaccttaacaaagcaccgcctgctttcaggaacatccaggttaaagagcctcctctcacgaatctccaggttgcccaccaggaaggttctgtcttctcttttgttcctcctttgattttcaaatttgaaatcaccttcctcctcccacagccctgtgtctggattgagtgaccagagtttcactgtggatatgtgctctggcatcttgacctgggtcgagtcaaggtggaccttcactttgccagcattaagtggctctgaggtgacctcatctctgaagtccacagagaacatgccatacgtccgaagggggaaagtgtctccttcgtcattgatgaagttcaggtcagtctgggcagctgtggctgtggaaatattccggggatccaggaaggtcacactggccttcacttttcctatgtagggctccccattctgcctgtagaaactcctggatggaatctccagttcagccatggggtcttcaccaaccacttcccccagggggatgatgttggtctccatggcttccaaagtgatgggctttttccgacgaagcatcttgatttcatggaacacggcactccccttcttgttgaaaggtagcactttggtggtgttgacaaacttctgcagcctgtccacaaatgtgagcaccagcctctcagtgtcctgggggacatggagggtgaaagtgcccttgtagccagtcatgcttacacggctgttccccatgtacacatggccaaagcgcatgggctccccattgtcagcagcactgacacggccccgcacgatgctccgagtttccgtacaccgctggcagctgcactccttggccaccttggtgggtagcgtgtagccactgcactggatctccctttcctctgtcttggagatgccacagcagttctgcacagcatcacggcacctgatcccattatcctgctgccctgcacaagtcttaacagggcagcgtccca

SEQ ID NO: 2215 - DNA, 24 bp, Homo sapiens
gcggagacgcggcgcgctgcacag

SEQ ID NO: 2216 - DNA, 156 bp, Homo sapiens
tttatggcgtcgtacaccagagcctgcagcaacagcgtctgcccagttccagcagggggcagcagggcccgggtcagagccggccgggggcctgcctggggcagctcacagcctgcccaggaaccagcccagctcagcccgcttggttgagcccag

SEQ ID NO: 2217 - DNA, 24 bp, Homo sapiens
tgttccggcgcatggtctttgcat

SEQ ID NO: 2218 - DNA, 40 bp, Homo sapiens
cgaggatcactgaacgtgatccagtgcttcacacggtccc

SEQ ID NO: 2219 - DNA, 71 bp, Homo sapiens
gtgaagccctccaatatgctagtaaacacaagaggacaggttaagctgtgtgattttggagttagcactca

SEQ ID NO: 2220 - DNA, 24 bp, Homo sapiens
gaggatggggatgattacgaattc

SEQ ID NO: 2221 - DNA, 135 bp, Homo sapiens
acaaccgttgctgggtgtcccagggcctgaggcaggacggtactccgctgacaccttccctttcggccttgaggttcccagcctggtggccccaggacgttccggtcgcatggcagagtgctacggacgacgcct

SEQ ID NO: 2222 - DNA, 24 bp, Homo sapiens
ggcttggtgtggtgcagcacctcc

SEQ ID NO: 2223 - DNA, 47 bp, Homo sapiens
gtgcagacatggtcggacacagggcacacccagatgttcccatgctt

SEQ ID NO: 2224 - DNA, 120 bp, Homo sapiens
gtccagcgccacggtctcgaaggcccttcgcatcatggggtactcctccagcacctcattgaagttgtccacgctcagcgagtagaggcggcagtaggtgtcggccctcacgctggctgt

SEQ ID NO: 2225 - DNA, 142 bp, Homo sapiens
ctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgc

SEQ ID NO: 2226 - DNA, 39 bp, Homo sapiens
tggagcccatggagaccgccgagccacagtcctcgccag

SEQ ID NO: 2227 - DNA, 26 bp, Homo sapiens
gcaaagcggaacaggtcatcactgat

SEQ ID NO: 2228 - DNA, 62 bp, Homo sapiens
gagtctgggcggttcggcgaggcccccagcatgccttttctccgcagaacggccttggccag

SEQ ID NO: 2229 - DNA, 156 bp, Homo sapiens
cctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttg

SEQ ID NO: 2230 - DNA, 180 bp, Homo sapiens
cctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtct

SEQ ID NO: 2231 - DNA, 24 bp, Homo sapiens
ctgagggtctgactgctgagtggc

SEQ ID NO: 2232 - DNA, 26 bp, Homo sapiens
gcatcaagtgcgccaagtgccaggtg

SEQ ID NO: 2233 - DNA, 30 bp, Homo sapiens
ggagctgcactacccgctgggcgagcgccg

SEQ ID NO: 2234 - DNA, 129 bp, Homo sapiens
agcagccaattagcccaatgatgaaaagcagggctcctacagctatgatcactacagcagggatgagcgtgtacacatcttcaaagaagtggtcatagtcatcataagtgatgaagacataggctccca

SEQ ID NO: 2235 - DNA, 59 bp, Homo sapiens
gtggagacatgatgaaaggtcgtttcccaacgggctcacagtcattgccgcttccgtca

SEQ ID NO: 2236 - DNA, 92 bp, Homo sapiens
tacctgggagtgttagacctcagcccagtactttgcccacttgtggatgcccagtggccagcccacgggtcttcctgccctagccccaatcc

SEQ ID NO: 2237 - DNA, 53 bp, Homo sapiens
agtggacaaagtagcgggcagttccaagggcggccctcggaagtctggtcgca

SEQ ID NO: 2238 - DNA, 94 bp, Homo sapiens
ggcgtcagtgactgcacagccacagcttaccccaagttcaccgagagggctgtcgtagacgtgccgatgcccaagaagctctttggttctcagc

SEQ ID NO: 2239 - DNA, 87 bp, Homo sapiens
aatggagagggttaaaaacatgcaaactgccactttcaacctttgccagtattccctctacccccgtgagagctatctggggggaag

SEQ ID NO: 2240 - DNA, 297 bp, Homo sapiens
caatgacctcacagcggtaacgcccatagtcctccagccgcagatcctggatctccagcgagacgtcatgctctttgtcctgccgcaggtgcacgcggccttggtagtccccaaaggagcggtgcctcagcccgatggccaccagcacgtccttctctggggccccgttctccgacagcttccaccatttgacacgcacacgccgcggggagaccagggccggctcgtagcggtagcggcagggcaggatcacactggccccttggtaggtgaacagggtctcctcgggtgtctcca

SEQ ID NO: 2241 - DNA, 31 bp, Homo sapiens
tggatgtccaatgggttgtgccgcagctgcc

SEQ ID NO: 2242 - DNA, 169 bp, Homo sapiens
gctctgggccgcagcgaccctcctgcggaactcctggagccgagaccgctcgccagcatcctggagctccttgccctcgagctcccgcagctgcctctggccttcactcagctcggcccgcacctgctctgcctcctgctccagctcccggatacgctggctgtgctgg

SEQ ID NO: 2243 - DNA, 25 bp, Homo sapiens
agctgcagtctggagtggatgctgc

SEQ ID NO: 2244 - DNA, 29 bp, Homo sapiens
tggacaccaccgaccaccactttggcagt

SEQ ID NO: 2245 - DNA, 88 bp, Homo sapiens
ggcggagaccgcactcatcttacaccgcaagggttttgactgcggcctggaggccaagaacttgggcttcaactgcaccacaagccaa

SEQ ID NO: 2246 - DNA, 53 bp, Homo sapiens
tctgcccaggaaccggagggctgagatctcagagaatgtacaaccacccaaga

SEQ ID NO: 2247 - DNA, 32 bp, Homo sapiens
acggggccagccttcgcgtccgagctcagggg

SEQ ID NO: 2248 - DNA, 87 bp, Homo sapiens
tgtctgccccacactcggtgccatccaggggagggtccagcttggtcttgcaggatgtgtctccttctaccaggcaccacagtccag

SEQ ID NO: 2249 - DNA, 154 bp, Homo sapiens
acacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaa

SEQ ID NO: 2250 - DNA, 134 bp, Homo sapiens
tatcccgctgctgcacggtgtctgcccacagcagggacccaacaaatatgcatccagtgaacaaagggacgaaggcccctcagcagctctgtaaatgggctcctgtccacagtggggtgatgcaacatgccctc

SEQ ID NO: 2251 - DNA, 60 bp, Homo sapiens
ttagagccagagccgtagaccacttatagcctccagtccaattgcaatatagcattttgg

SEQ ID NO: 2252 - DNA, 62 bp, Homo sapiens
aagtcaactcccaaatagccctagaatacggccaggcaatgacggtccgagtgtgcaagatg

SEQ ID NO: 2253 - DNA, 104 bp, Homo sapiens
tagcctagccctcccgagcctccctgggggtccactgtccgccagcctgccgaccgcagaccaccgctcagccttcttcttctggggcctccacgagctgggga

SEQ ID NO: 2254 - DNA, 75 bp, Homo sapiens
gggcgtctcgtctggccggagcatgaggctacgggggtcgcgcagcgggtagatgtagccatgctgcaccaggac

SEQ ID NO: 2255 - DNA, 78 bp, Homo sapiens
cagtgaggcggagctgtccccagagaccctatgcaacgggcagctgggctgcagtgaccccgctttcctcacgcccag

SEQ ID NO: 2256 - DNA, 25 bp, Homo sapiens
cctggctcagcccgactgccctcct

SEQ ID NO: 2257 - DNA, 96 bp, Homo sapiens
gcgggcagggcagtgtgcggctctggcggctgcgtggcggggtgctgcgttcctgccccgtggacttaggggagcaccacgcgctgcagttcaccg

SEQ ID NO: 2258 - DNA, 63 bp, Homo sapiens
acagatggtctgctggccacatcgctggacgccacctgtgacgttgcctgcttgatgtttgat

SEQ ID NO: 2259 - DNA, 34 bp, Homo sapiens
ctcaagtttggagccgtttccgtggttgtagcag

SEQ ID NO: 2260 - DNA, 36 bp, Homo sapiens
ctcctgatgctccagcgcccacttcacttccccctg

SEQ ID NO: 2261 - DNA, 24 bp, Homo sapiens
ctgcggccacgagcacacgcttag

SEQ ID NO: 2262 - DNA, 65 bp, Homo sapiens
tgagacggcccgatgaagtcatccaggtccgtcagctgcagcgccccgctgaagggcgacgccat

SEQ ID NO: 2263 - DNA, 41 bp, Homo sapiens
ctgcgcccctggacggagtcctggccaacccacctaacatt

SEQ ID NO: 2264 - DNA, 93 bp, Homo sapiens
accccgagtctgtgatccagcacctgggctacctcttcctcaagatgagccctgaggacattcgcaagtggaatgtgacgtccctggagaccc

SEQ ID NO: 2265 - DNA, 257 bp, Homo sapiens
ggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactc

SEQ ID NO: 2266 - DNA, 102 bp, Homo sapiens
gttgcgccgcctgtcccggctattgtggtagtgtgggcacgcatagccctggcggcacaggcgtggcggcttcgggcactgctccgtcttgtagctgcccag

SEQ ID NO: 2267 - DNA, 63 bp, Homo sapiens
gtgtgattgatccgccgctcctcctccaggaacagctggttctcactgttgtcatagtccaag

SEQ ID NO: 2268 - DNA, 24 bp, Homo sapiens
tgctccgcaccgatgcaggagaag

SEQ ID NO: 2269 - DNA, 191 bp, Homo sapiens
ccagcccagcttgttgtgtagcacctgcttgaggcccggcggcagcggcagaccctccagcgtgtctcccgagtctggccgcagctggcgcaggcggtggcagcacaggtactggagggaagtggcgctggcacaggagcgggtgaccttcatgctgctccgggccgccgtggagcacaccatcgggtaga

SEQ ID NO: 2270 - DNA, 37 bp, Homo sapiens
tgcccatcagagtcgtagccccagttagtggagcctg

SEQ ID NO: 2271 - DNA, 29 bp, Homo sapiens
tacatgtagttgtcggtcagggcaggcag

SEQ ID NO: 2272 - DNA, 306 bp, Homo sapiens
ggactgcaaaacaccggcgtcggcgcgtcgcagccaatcagcgcccgcctcgcgctgccctcagccaatcagcgtccacctcgcaccgtccgccaaccaatcaacgcgctcgcgctcaacttgttttgtccgcgagccccgactgccacgggccgggagacgggcctgggagcggcggcggcggcccgagagctgcgccgggagagctgtgccgcgagcctccgcctcttttttggcaccgcacagtggatccctggaggccgagcgccacgccgcccgggtacccggcagatcgcgaggtggaac

SEQ ID NO: 2273 - DNA, 482 bp, Homo sapiens
tttgccgaccctgcaacttgatggatctgctggcaccaaccagattgataaactggctcatctgatcttgtggccaccacccaggagctgactcagcgcaagaagacagctgactccctgtgatttcctccctgaccaatcggctctcctggctcactggctctccccacccgccaagttatccttaaaaactctgctccccggcactccagcagcctgggcgacaagatcaagactctctcaaaaaaaaaaaaaaaaaaaacctctgctccgcaaatgctcaaagagatcgatttgagtaataataaaacataaaactccggtctcccgcacagccagctctgtgtgaattactctttctctattgcaattcccctgtcttaatgaatcggctttgtctaggcagcaggcaaggtgaaccccttgggcggttacacagcgctctgagacctcgcaggaagagtcgcctccggcctttgtta

SEQ ID NO: 2274 - DNA, 33 bp, Homo sapiens
cctggatgtgttccggaaggggtggctctttgc

SEQ ID NO: 2275 - DNA, 91 bp, Homo sapiens
acaacatgatctgcacgcagaccctgctgcgtcaccagggcagtgtcaccgcgctggctgtgtcccggggccgactcttctcaggggctgt

SEQ ID NO: 2276 - DNA, 25 bp, Homo sapiens
ggcggggccctcatccaggaggtac

SEQ ID NO: 2277 - DNA, 30 bp, Homo sapiens
gtcccccgggccggactcagagacggactt

SEQ ID NO: 2278 - DNA, 46 bp, Homo sapiens
gcgcggagcagaacgcgcgccgggactcgcacagaagccaccagcg

SEQ ID NO: 2279 - DNA, 56 bp, Homo sapiens
gctctctgccagcccgcacagcagtggaaggcaggcagggctgaataaagggtctg

SEQ ID NO: 2280 - DNA, 26 bp, Homo sapiens
gtgtgggaggttgattgtaaagaaaa

SEQ ID NO: 2281 - DNA, 27 bp, Homo sapiens
gtgtctgcgccgagaaggacttggaga

SEQ ID NO: 2282 - DNA, 26 bp, Homo sapiens
ctgacccaggctaggttgattttttc

SEQ ID NO: 2283 - DNA, 849 bp, Homo sapiens
aattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggctggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtc

SEQ ID NO: 2284 - DNA, 25 bp, Homo sapiens
tgttgctgccttggccctctgagac

SEQ ID NO: 2285 - DNA, 25 bp, Homo sapiens
tccccttcccctgctaagcctggcc

SEQ ID NO: 2286 - DNA, 87 bp, Homo sapiens
actgcacggcgcgggcgataccgttgcaggggttgcatgccacggtgccctcggcgcccggggcccggcacgaggtctaaacatcgc

SEQ ID NO: 2287 - DNA, 26 bp, Homo sapiens
aggtatcctggccgcattgaggatgg

SEQ ID NO: 2288 - DNA, 76 bp, Homo sapiens
cctggagcgcggacctggacaagtgcatggactgcgcgtcttgcagggcgcgaccgcacagcgacttctgcctggg

SEQ ID NO: 2289 - DNA, 121 bp, Homo sapiens
catgagtgcggagacagcttctctcacagctccaatcggattcgccacctgagaacgcatacgggagagagaccctataaatgttctgaatgtggagaaagcttctctcggagttcccgtc

SEQ ID NO: 2290 - DNA, 36 bp, Homo sapiens
gggccttggcacctccatcaccaatactattactgg

SEQ ID NO: 2291 - DNA, 38 bp, Homo sapiens
ccaggccaggctcgcttgcgcgcagctgattcagcttc

SEQ ID NO: 2292 - DNA, 143 bp, Homo sapiens
gggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcac

SEQ ID NO: 2293 - DNA, 57 bp, Homo sapiens
ggtgagacgtggtgtggcgaaggctggggctgtatccgtggtgacgggctggaatgt

SEQ ID NO: 2294 - DNA, 24 bp, Homo sapiens
ctgtgccgttactgctactctctt

SEQ ID NO: 2295 - DNA, 731 bp, Homo sapiens
aagcaggcttcatcccggaaatggtagccaaaggtctcgaaaaggacagagtaggccacccccagacacaaactcaggtacaaaggtaagtgcatgacggtatagagcaaaaagagcacttcgatgcacatggagaagctccccacttgagataagcaagtatctgtgggccgggctgtggccgtaaggttggagctgtcgccgcgtcctgagacaggcgtcaagacctggaactgcgcagccagggtcagggcgaacaccagcagggtgagagccagcgaggtccacgcgtaatgccgggcgtacagcttggtgaaggtaaacagaaagaagcccacacacaccaggaggaagcacagcgcgggggcgaccatgacgatcagtctggatctcatgtggaccgcaaaatagatgctccacagaaggcaggcgaagccgatgtagaagagcgcataccggaaccggcgctgggtctgcgggaagcagcgctccaggcaggcctcctccaggttcaccgagtcgaacttggggtcccaccagcggctggaggccctctcgaacagctggggcagcttcttctgcctgcgcagccggcctccgccgcccactcgccgggggacgcccccggagtccccagagctgctgcagctagaggagatgctgtatttgcagtgcttggggtggctgttggaggacagctgcttggggttgatcttgacgcgcacgctgtt

SEQ ID NO: 2296 - DNA, 226 bp, Homo sapiens
ggctccgggaccgctttgctcgctcgccttccgcgcctctcgccccgagggtggcctccgcgccgcgcggcttctcctcctcgcgcgctcgcctcctccagctgcggctccggagggaagttcagaccttgagcgctcccagccccgcgagccgcctgcgcacaaacaactccgctggcggcgcggagccctccatcctgcaggagccgcgctccgatgcgtcaaa

SEQ ID NO: 2297 - DNA, 55 bp, Homo sapiens
ccagggcgctggagaagaaccgcgtgtcccacagcttcacttcgcgctcacgcat

SEQ ID NO: 2298 - DNA, 561 bp, Homo sapiens
tcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtca

SEQ ID NO: 2299 - DNA, 96 bp, Homo sapiens
gcctgggcgggacaagttccaggagcccgggaccccgattctgcggccgagtccactgcagaggcggggatggagctgcgcgctaggcgccaactc

SEQ ID NO: 2300 - DNA, 281 bp, Homo sapiens
ggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatc

SEQ ID NO: 2301 - DNA, 41 bp, Homo sapiens
cagaagggtctgtagctccagtagctggagaacacggagat

SEQ ID NO: 2302 - DNA, 48 bp, Homo sapiens
agggtgttcaaggcgggacacaccaggctagagatccgcgatcgggcc

SEQ ID NO: 2303 - DNA, 26 bp, Homo sapiens
gttggacccggtccatccggcatcac

SEQ ID NO: 2304 - DNA, 60 bp, Homo sapiens
aggactttctctctgggtccccttccaaaacgcagccaccgccgtcaccaatctctacaa

SEQ ID NO: 2305 - DNA, 745 bp, Homo sapiens
tgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattg

SEQ ID NO: 2306 - DNA, 113 bp, Homo sapiens
tgctcccagtcgccggctttataccgccgccgccgcctcgggcccgaaggcccggcccggcccgttgctccccaatcccgcagctcgccgcacccgctaacccggacgctcca

SEQ ID NO: 2307 - DNA, 42 bp, Homo sapiens
ggacttgcaatgcgtcaagagagcgtccactgcctttctaac

SEQ ID NO: 2308 - DNA, 114 bp, Homo sapiens
gaactcctcgacggtctcggccgtgggggtgttgccaatgtcatggttgccgctgacaaggaccagtgggatggccctgtccactgccctaagcactcgcttcaggtcctccgt

SEQ ID NO: 2309 - DNA, 122 bp, Homo sapiens
cctcctcgctgaaacccatgattgccatggcctccacggtttcctggaacatctcatcatcctgggctgctgggatgggcacaaagccattggagaggaaggtgtagttgttgaagccctcc

SEQ ID NO: 2310 - DNA, 56 bp, Homo sapiens
ggccgtgtactccaacgctgacatttacctcttcgatgatcccctctcagcagtgg

SEQ ID NO: 2311 - DNA, 30 bp, Homo sapiens
tggcatgctggtgacggacagtgcagggaa

SEQ ID NO: 2312 - DNA, 162 bp, Homo sapiens
agtccatcacggagcgcaggcggtgggcaatgagcagcacagtgcactgtgcaaaccagctcccgagcatggcctgcatctgcagctccgtgccagggtccacggcagcagtagcctcgtccaggatgaggatctgggtcttccggagaagggcacgtgcca

SEQ ID NO: 2313 - DNA, 127 bp, Homo sapiens
actgcagggtcgtccgcccacaggctcagccagtagccccggcagaaggaggccacttgctggcagaggaagaggaagagtgcgtagaggcagaggggggtgcccacggcacgcaggtaggccaggt

SEQ ID NO: 2314 - DNA, 24 bp, Homo sapiens
ctcgagggggcagaaccgagtcac

SEQ ID NO: 2315 - DNA, 52 bp, Homo sapiens
aaatatcaatcattggcattctttgttactattggctcaacaccgtggccct

SEQ ID NO: 2316 - DNA, 44 bp, Homo sapiens
gacactgatggtggccggttggtagaccttcagcagatctttca

SEQ ID NO: 2317 - DNA, 24 bp, Homo sapiens
gcagaaccaaaggtcactctttcc

SEQ ID NO: 2318 - DNA, 29 bp, Homo sapiens
ctgcttccccggatgagcagaaggtgttt

SEQ ID NO: 2319 - DNA, 135 bp, Homo sapiens
gcaaagctgggtgccggtttctcctggtcacactttcccgggctccttctcccttggccagatgacttcagctcctccacttggctctggaggtgatcaatgttggtttgcaggcattcaatcgtttcagtcagg

SEQ ID NO: 2320 - DNA, 24 bp, Homo sapiens
gaagaactggagttgcttggctct

SEQ ID NO: 2321 - DNA, 26 bp, Homo sapiens
tgcggcagggagaggcatgaaccagc

SEQ ID NO: 2322 - DNA, 24 bp, Homo sapiens
tgagctggttcacagagccaccct

SEQ ID NO: 2323 - DNA, 58 bp, Homo sapiens
aaggtttggccacggaagcagcaagatgttagagagggctcggcacaccaacacctgg

SEQ ID NO: 2324 - DNA, 63 bp, Homo sapiens
gtgcggttcttacagaagctccggcatcccaacaccattcagtaccggggctgttacctgagg

SEQ ID NO: 2325 - DNA, 85 bp, Homo sapiens
atgagctcttcgttcttccctttgatctctacgctcatgggtgtccttggaaacctctggaacaggtcctccagacgaaccatgc

SEQ ID NO: 2326 - DNA, 32 bp, Homo sapiens
cacctctatggcagcaacgcctccctggccca

SEQ ID NO: 2327 - DNA, 80 bp, Homo sapiens
catctcacggctgcggcgcaagctggaaaagcagaggaaggtggaggtctacgcagatgccgacgaaatcctccaggagg

SEQ ID NO: 2328 - DNA, 105 bp, Homo sapiens
cagcgctcacagcgatcctggcgcctggcctgtgagtctgcctcctccaccgaagtgtctggggccttgaagagcaccagctgcagcataaaccaccccatcttc

SEQ ID NO: 2329 - DNA, 65 bp, Homo sapiens
tctcgagtacgtgccacaccaaggagcgcttgccctctcactccgactttctggctgagcttcgg

SEQ ID NO: 2330 - DNA, 43 bp, Homo sapiens
ttaaatgacattgcatcgaagccctcccaggaacacatattta

SEQ ID NO: 2331 - DNA, 37 bp, Homo sapiens
actgagcgggggtcaagacctcacccaggatggactg

SEQ ID NO: 2332 - DNA, 25 bp, Homo sapiens
tgcggaaggaaagatttcagatccc

SEQ ID NO: 2333 - DNA, 29 bp, Homo sapiens
tcccagcctgacaagctttccactcacag

SEQ ID NO: 2334 - DNA, 137 bp, Homo sapiens
ctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgct

SEQ ID NO: 2335 - DNA, 85 bp, Homo sapiens
tggagtccatgaacccgcaggtgaaggcggtggagtacgccgtgcggggacccatcgtgctcaaggccggcgagatcgagctcga

SEQ ID NO: 2336 - DNA, 32 bp, Homo sapiens
ggcagaagttccaggtcccgattcagggagca

SEQ ID NO: 2337 - DNA, 55 bp, Homo sapiens
agcgggacccctacctcaaggagatgaacatccgcacctacctggtcatcgaccc

SEQ ID NO: 2338 - DNA, 62 bp, Homo sapiens
tcggcacagcaccggccacagacgtgggcatccttgctcttagtagggcgactcggttgacc

SEQ ID NO: 2339 - DNA, 30 bp, Homo sapiens
gcgcttcgccgtttgaatggctgcgggccc

SEQ ID NO: 2340 - DNA, 81 bp, Homo sapiens
aagggcgccggattgccttcatcctgtacctggttcctccctgggacaggagcatgggtggtaccctggacctgtacagca

SEQ ID NO: 2341 - DNA, 52 bp, Homo sapiens
ttgtctcaggttaacctctgtgaggacgatgatgccagttccctgctgctgc

SEQ ID NO: 2342 - DNA, 33 bp, Homo sapiens
ggtgacttccaagagtgactccgtcggaggaaa

SEQ ID NO: 2343 - DNA, 945 bp, Homo sapiens
gagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatctt

SEQ ID NO: 2344 - DNA, 77 bp, Homo sapiens
gacatgggggttggccatcttcaccccgttgggcctctccaccgtctacatctttgcacttttcaactccttgcaag

SEQ ID NO: 2345 - DNA, 75 bp, Homo sapiens
gcagcagtgggaagccgcgcacctgccgcttgagcccattgtagtcgttggtgagggtccgcagtgccggctgca

SEQ ID NO: 2346 - DNA, 115 bp, Homo sapiens
agtgccaggtgtactcgtaccaggtcttgacgcggttctgcacggacttggggatcttgtagaaattcatgtacttcaccgtgctgtccatgcagctgcggtagtaggtctgtcc

SEQ ID NO: 2347 - DNA, 115 bp, Homo sapiens
cagaggtgacgtcagggtcaatgagtttctccttcactttctctgtccgctccttgaagagcttcaccagctcctggagccggtcgttgatgatggcgctatttgtgctggccgt

SEQ ID NO: 2348 - DNA, 142 bp, Homo sapiens
actggctgcggctttatggctacctgcctcagcccagccgccatatgtccaccatgcgttccgcccagatcttggcctcggcccttgcagagatgcagcgcttctacgggatcccagtcaccggtgtgctcgacgaagagac

SEQ ID NO: 2349 - DNA, 54 bp, Homo sapiens
aaatattacgctaaactggagcccagggatcagcgacctccacgattatcagaa

SEQ ID NO: 2350 - DNA, 35 bp, Homo sapiens
tccccagagagacccgccgcggacaccatgggcag

SEQ ID NO: 2351 - DNA, 80 bp, Homo sapiens
aatggtcctcagagttcgtccatgaactgttcctgctcaaggagaaatgaactcaggctggcctgacacagtagagttca

SEQ ID NO: 2352 - DNA, 26 bp, Homo sapiens
tggcgacccaggcgaagcgtccacgg

SEQ ID NO: 2353 - DNA, 98 bp, Homo sapiens
agggtaggaggtgagcacgctcaggatgatgaaggctcgggcaacggccacggccatgtcctccgagggataggacaggagcacgtcaggatccacag

SEQ ID NO: 2354 - DNA, 79 bp, Homo sapiens
cggcgccctagcagatgcacgtgtctgtcgaatcgctgcctccgagcccacccccgagctcgcatgctgtcacccattc

SEQ ID NO: 2355 - DNA, 76 bp, Homo sapiens
acagtcgccttcaggggcacgctgtctgctggttgatccgggtccttcttccttgacatggtccagtgggtgaaaa

SEQ ID NO: 2356 - DNA, 49 bp, Homo sapiens
cctggaggtagtgcccgaacgctctctggggaacgagcaatgggaattc

SEQ ID NO: 2357 - DNA, 35 bp, Homo sapiens
tgtgcttgcggagccgtccggcggctgggatcgag

SEQ ID NO: 2358 - DNA, 126 bp, Homo sapiens
gggcccaacaacactggacacccggccactgcagtcttctgccctgctggacagcagcagcagcagcagcagcagcagcagcagcagcagcaacagtaacagcagcagttcgtccggacccaaccc

SEQ ID NO: 2359 - DNA, 87 bp, Homo sapiens
ccgcgaggacaagcacgagtgcccctttgcccggggcagcatccagctgacggtgctgctgtgtgagctgctccgtgttggggagcc

SEQ ID NO: 2360 - DNA, 113 bp, Homo sapiens
acagcccaggacttctcacccatgttcttcggccaagaccagagcttccacgagctcttctgtgtgggcatccagctgttgaataagacctggaaggagatgcgggctacaca

SEQ ID NO: 2361 - DNA, 71 bp, Homo sapiens
gttgcccaccgctaggagggtagccaggatgcagcggaaggtggcattctgtaccagctgttccataccca

SEQ ID NO: 2362 - DNA, 180 bp, Homo sapiens
ggaacaaggatcccaaagccgatcacagcaaagaagaggtacagcagccaggccacaatctggagcgggtgagggggccagctccacccattccggcgggatcgctggccctgcagctcaggggagggtccgctgggctgtgccggtgccgtccacacactcttctcaggggccgtcttg

SEQ ID NO: 2363 - DNA, 36 bp, Homo sapiens
tggacctggtgtacacggcgctgaagcggggcctga

SEQ ID NO: 2364 - DNA, 78 bp, Homo sapiens
cggccgcctgtagttgtcaggacagagcgtcgggtctggggggatgggccccgagatgcgggacgggccctcgcacat

SEQ ID NO: 2365 - DNA, 25 bp, Homo sapiens
tgcaggcaccaaagagaaccacact

SEQ ID NO: 2366 - DNA, 28 bp, Homo sapiens
ttccgccccggtgctaattattcttagg

SEQ ID NO: 2367 - DNA, 63 bp, Homo sapiens
tccacaagaactcaactggcaaggctgcttttctgtgctaaaactggggagctagtgggcacc

SEQ ID NO: 2368 - DNA, 26 bp, Homo sapiens
cccacagagccaccgtctatgcacag

SEQ ID NO: 2369 - DNA, 32 bp, Homo sapiens
cccgctgtgggagtacccatgccgcagcctct

SEQ ID NO: 2370 - DNA, 67 bp, Homo sapiens
agagccacgcagcggtgctatggatggagtaccacctgaccccggagtgcacgctcagcactggcct

SEQ ID NO: 2371 - DNA, 49 bp, Homo sapiens
ccgaagacaccatcagtcgcatggctactggcaggtggtccgtcaggcc

SEQ ID NO: 2372 - DNA, 327 bp, Homo sapiens
aaggacagcccaaagtacatgcactggcccagcagagagtccaggtggccgcctatgccccggtaaaggtcggtctccagcacctgcaggaattgtgagaccttctgtagcacccagccatggaagatggcactctcattcacagtgtgctcacccatggcagggggcagcagtgggtcctcgtctgagaagatggcacggtactgggtgatgatatcaaagagatggacacgggaggcctcgatggtttttgtaatatggaaatagggatcatcattaggaatggcagtcaggatggaccggagccaagcatctcgggcctgaaga

SEQ ID NO: 2373 - DNA, 135 bp, Homo sapiens
tggcattagagaagctcggtgctgtcttcaatcaagtagccttcccactgcagtacacacccaggaaatttgtcatccaccctgagagtaacaaccttattatcattgaaacggaccacaatgcctacactgagg

SEQ ID NO: 2374 - DNA, 25 bp, Homo sapiens
gcttgaagccgcccgcactctccat

SEQ ID NO: 2375 - DNA, 33 bp, Homo sapiens
cccgaaacctcgaatgaaaccagcagctccggg

SEQ ID NO: 2376 - DNA, 56 bp, Homo sapiens
aagaacaagacctcagtggacgccgcggaggactacgcagaaggggtgcgcgtact

SEQ ID NO: 2377 - DNA, 25 bp, Homo sapiens
ttggtagttgtggagtagttacaca

SEQ ID NO: 2378 - DNA, 92 bp, Homo sapiens
acagagcgcccctgctccagggaggaggctcaccggaccctggggcagagctgagcttgggacaccagcgggaacagggcaccccttctgca

SEQ ID NO: 2379 - DNA, 1042 bp, Homo sapiens
actgcccatctggcgagtcctgggaggtgaacttagggggtgagggcaggggtcgtgactggatgctgctggtcttgtcagtggggttggggtgcagggtgccacccccctcaggccccggggcagtggccttggtccgtctgaagagcagtgaggcattgccgtgcaggaaggaggccagctgcttggcgtcctcgggcacagcccgcgagcaggccaccagccggtccaggtcctcaagggtggctccagagcctccccggccagcgtcgagggcctgaccatgtgccaccagcgtctggtgcacgtcctccatcttctgcagctgccggctaagcttggcatgcagggcacggtcagatgtgtgggcagcattgcccaccgcgctgcgggcaaactccaacagctcgtggacggcactctggacagcggccacagcagcctgcaggtcctgcaccagcggctcctgtggctcagaggggctacgccagctcccagtcgcaccggcgctgcctgccaggtccagaaggtgggcaacggtggcgctcacaccctgctgcagccgtgccagggcctccacagcaacttccagctccaggggttcccggcccggccctgccacctccaaggaggacgcagactggctgctgcgtgtgctgccggtgctggaggccgacaggcgcttgccctctgccggggcttcacgttcagctgggggaggcaccgcatacacaccactgtcgaccacgccaccatcagccacctcaggaggaagcacccgttcacggggcacatcgtacagggtgcccgggccaggccgccgcaagccagggggcacgtcgtagaggtcaggagccgggggcggcacgtcatacacgtcctcggccggcggggagtctggagggggcgcagccagtaccagtggggtgcgggccgggtcaaagggcttggccttggcgaaggcggggggcacatcgtaggtctcctcacgcagcagtgggccatcgggcacatccttgctcaccgatggaggaacgtcgta

SEQ ID NO: 2380 - DNA, 81 bp, Homo sapiens
cctgggctgaagtgatccacccacctcagcctcccaaagtgctgggattacaggtgtgagcccccacacccggcctgcatt

SEQ ID NO: 2381 - DNA, 213 bp, Homo sapiens
agaccagcgtctcatttgtgggccctggcgcgtacagacgttccgggcggttgaaagagcgctggtattcaaacgtggtcccagcgaaggggaactccccaggccagtcgatgctccagcccccggtgaggtaatacttttgactgaggcttcgaactgcgaggtaactggaggaaacctgcagctcctggatttcgatgcttcgggcgccag

SEQ ID NO: 2382 - DNA, 79 bp, Homo sapiens
gatgccatctccttgacccgcagcatgacctcctggctgaacgtggtgggccagaagacctgcgacaccagccccctgc

SEQ ID NO: 2383 - DNA, 26 bp, Homo sapiens
tgctctgttggggtgttgtccaaata

SEQ ID NO: 2384 - DNA, 24 bp, Homo sapiens
tgatttctcccgattccttccttc

SEQ ID NO: 2385 - DNA, 110 bp, Homo sapiens
ctggctggcgaggcagagcctctcctcaaagcctggctcccacggaaaatatgctcagtgcagccgcgtgcatgaatgaaaacgccgccgggcgcttctagtcggacaaa

SEQ ID NO: 2386 - DNA, 171 bp, Homo sapiens
gccggcgcgcacaggctgctccgggagccgccgcagcagggccgggcgctgggcgggctgctgcgctgggtgggcgccaggatgggcgagccccgggagtcgctggcccccgccgcccccgcggaccccggcccagcctcgccgcgcgggggcaccgccgtcatcctggac

SEQ ID NO: 2387 - DNA, 135 bp, Homo sapiens
gcccacaatcacctggagaccgtggaggacattcagcatctacaagagtgtttgaggctttgtgtccttgacctttcgcacaacaagctgagtgacccggagatcctgagcattctggaaagcatgcccgatttg

SEQ ID NO: 2388 - DNA, 32 bp, Homo sapiens
tgcctcagtacgtcctccctgtgcagcttggc

SEQ ID NO: 2389 - DNA, 28 bp, Homo sapiens
aggagtatgaggacgccgtcagcatcgc

SEQ ID NO: 2390 - DNA, 121 bp, Homo sapiens
gtcaggggcgatcgtggccatgactggggatggggtgaacgacgcagtggccctgaagtctgcagacattgggatcgccatggggcagacagggacggacgtcagcaaagaggccgccaac

SEQ ID NO: 2391 - DNA, 116 bp, Homo sapiens
agttctcctgagccgacagctgcgggctgttgtacgtggtgcacgtgggcttggctctgctgtgtcctttcccaaaatcaacatccacccaaagcccaaagtaattgtgctgcccc

SEQ ID NO: 2392 - DNA, 65 bp, Homo sapiens
atttggactgctacacgaccgttgctcagctgtgcccgtttgaaaagccagcaactcactgccca

SEQ ID NO: 2393 - DNA, 71 bp, Homo sapiens
acaaatgcccacaagggttgggtccagcccagttttcactgtgcaggcagatggtcggcagtcactggatt

SEQ ID NO: 2394 - DNA, 78 bp, Homo sapiens
tcagaaagggagcggctccaggcagaactggaccacttacgaaagtgccttgccttgcctgcaatgcactggcctagg

SEQ ID NO: 2395 - DNA, 33 bp, Homo sapiens
ctggaggttcgtgcggagtttgtacatgtggtt

SEQ ID NO: 2396 - DNA, 296 bp, Homo sapiens
aggagcccttgtcacatctcacagaaccatgagtcgggaaacagattttgggaaatgctgatcataggctagttggcctctgggtccagttgtcagcctttaccatgtggcccagccagctgcagcctcattcccggccaccagcccccactctccacagcgctccagcctccactctccaaagtgctcacacttccccagactccctaggctcctggggccccttcgtgcctttgcatatgctgctccccccgcctgggatgctctttcttcctctgcctgagtaacaagctcct

SEQ ID NO: 2397 - DNA, 73 bp, Homo sapiens
tgtcttcgtcgtcgaccccaccctcggcgccctcaacctcctcactgtcctcttccgagtccgtctcctccag

SEQ ID NO: 2398 - DNA, 55 bp, Homo sapiens
gcctcgcccctgcgcgctcgcccggccccgcggccgacggccccatcgacctgag

SEQ ID NO: 2399 - DNA, 39 bp, Homo sapiens
cacggtaccccacactgctactcggctgaggaactgccc

SEQ ID NO: 2400 - DNA, 26 bp, Homo sapiens
gcgcgggaggcgcgtgccaggcaggg

SEQ ID NO: 2401 - DNA, 124 bp, Homo sapiens
tgcgccagtaggcagggaagtcctggaactggaaggtgtagacggcgatgaggaccagcatggtgtaggccaccacgagccaccagaaggccttgagcagcttccgccacaggctgtagtagac

SEQ ID NO: 2402 - DNA, 559 bp, Homo sapiens
aaaccaggctgagccggggatcaggccacctccgcagggacccactgctgcctcttccaggagcccaggagacccagtgggtctcctgcccccgactccaactccctcctggcaggacacacccagctcacagtggcctttccatcctgggaaagggagtgagaggaggctcaggccagggacccgcccagctctggccggcaaccgcccttcagcctttcctgaaccactgtgtgggccccaacccatccgctgcctgccggagggagcccatggggaatggactattcttgccacccctatccatggcaggggaggggctcagcatggctcttgcccacccagaagaaggtgcagggggcctggcgtggtggttcacacctttgggaggccgaggtgggtggatcacctcaggtcaggagtttgagaccagcctggccaacatggtgaaaccctgtttctactgaaaatacaaaaattagccaggcgtggtgatgggcacctgtaatctcagctactcaggaggctgaggcaggagaatcactttcacttaaaccca

SEQ ID NO: 2403 - DNA, 124 bp, Homo sapiens
tctgctccccattggcgcccgcggtgaagggcagcttccgcttgctggctcgctccctcacctccttcccgccatcgccacgctccagttttggggtcttggttagagaaactttatctttatc

SEQ ID NO: 2404 - DNA, 223 bp, Homo sapiens
tcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctg

SEQ ID NO: 2405 - DNA, 66 bp, Homo sapiens
tgtgggctgcatactggccgagctgctggcgcacaggcctcttctccccggcacttccgagatcca

SEQ ID NO: 2406 - DNA, 25 bp, Homo sapiens
tgggcacgcccagtgagaacatctg

SEQ ID NO: 2407 - DNA, 25 bp, Homo sapiens
gagcacacgtccacacatggtcctc

SEQ ID NO: 2408 - DNA, 24 bp, Homo sapiens
tttattggcgttgggccagcaagg

SEQ ID NO: 2409 - DNA, 281 bp, Homo sapiens
ggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatc

SEQ ID NO: 2410 - DNA, 25 bp, Homo sapiens
gcactcgggggctgatctcatctgt

SEQ ID NO: 2411 - DNA, 32 bp, Homo sapiens
tcccgaacctgctggagttatcgttccggagg

SEQ ID NO: 2412 - DNA, 843 bp, Homo sapiens
aaagtaagtcagggagtcccagcagggactgtaaaagaacttgggaagctatacacatgcccacgatactgaccctgtcccggacctctctgcatgagaaggccagagcccagcacccctcctacagaggcactgctgcttctgttggggctgtgaccctggaattctgatggaagcagctggtctgaaggggcatggcacacactcaggtactacccctggagctgaacctttatcataagtccctctgagtgctagtcagtttggaggtgggtgaggaggaaagggggtacttaaaagaagccaacactgttgcccagcagcaacaccatccgtggggatggaacagaccagggacatcctcctttatgtttatgtgggctgcaattccagatccaggctgacctcagctcataatggatgcttttcaactggggcaacaggtggaggtgggaggagcccttgttagggctaaagtgatatgtgtgggtctcaagagccaaaggaaggagactaacagctgctgaccctcagaccacatagacaactgtctgcctagaatgtcagtttgtttctttcaagataacccgcatctggacttcccctagttgatgaatgaaggaacatctttaagcacaaatataatgaatagctaacacagagcttataggaaaacactgacatttttctccagtaggaatgcctcttctccaactttccaagtcagataaatgctaccagcagttgagatgctacccagatgcattactaaagacccctcaaggtgaggagacttacacagaggaaggtgtctgtaacaagacatctggttccaaagggacc

SEQ ID NO: 2413 - DNA, 85 bp, Homo sapiens
ggttctgcagtaggggtaagcattccaggctttctcgtgtatattcagggctccctctggggccagcattcgaacaaacgtgggt

SEQ ID NO: 2414 - DNA, 122 bp, Homo sapiens
agccgactgaacagccgtaaggaggcggggctgctggccgcggtgacgctgactcagaagatcatcgtgtacctctcagacaccacactcatggacatcctgccccggatcagccatgaggt

SEQ ID NO: 2415 - DNA, 128 bp, Homo sapiens
cgactgggcggtgggctgaaccctgggcttgtccgtgccctggccatcagccccagtggccgtagtgtcgtggccggcttctcctcaggcttcatggtgctcctggacacccgcacaggcctggttct

SEQ ID NO: 2416 - DNA, 82 bp, Homo sapiens
gatttcatcgtcccatgggccacagtgcagcgacagaacctcctcagctttctgtattgtgctcagggcttcgggtactgca

SEQ ID NO: 2417 - DNA, 84 bp, Homo sapiens
tgaggctcggaagcgcctgaatccacagtgaaatatgagctcttccttggctttcacaggttcagtgttgccagggtcacgcct

SEQ ID NO: 2418 - DNA, 202 bp, Homo sapiens
tctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggc

SEQ ID NO: 2419 - DNA, 91 bp, Homo sapiens
tctgccgcagcacgcggtcaatctccagtacgtccatccactggctcagctcgtgcttgagctctgccagccgctgctgcgtggcaatctt

SEQ ID NO: 2420 - DNA, 103 bp, Homo sapiens
caggtcgccgtcggtgaagacactcaggaaggacaaggagttgcagtcaaccccgttgaaggcatcggatgggtccaggctcttgagcaggtctcggacatgg

SEQ ID NO: 2421 - DNA, 144 bp, Homo sapiens
aaaagcccgtgtcctgaatgacaatgacttcctggccggtggtctcatctcccgggccggcctcgtcaagcccattttccctgggtggctcggccgccgccgcctccttcttcaggctctctgggcagtccccgtttaagagca

SEQ ID NO: 2422 - DNA, 211 bp, Homo sapiens
actgtgtccttctgggccgagtgggttgagggagaactgaaatcaacacaaaaagaagtcccaaagaagagagagaccacggagagatgagagctgcaggtggaaaaggctttccgcttcccctgagctgatgggatcttcaggatggtcgagaaaacgttcgtgtaagagataatcaggcaaagcacacaaatgagtcctgtgagacccc

SEQ ID NO: 2423 - DNA, 98 bp, Homo sapiens
gacgtgcgtgcgtggaggtcatgcagcacgatgggggaggggcgggagtggggctgcagtccccagccccctgcctgcgggggcggctgttgcatgag

SEQ ID NO: 2424 - DNA, 45 bp, Homo sapiens
ttgatgtctggcaccccaattctcgtctcgggattcttgtctaac

SEQ ID NO: 2425 - DNA, 113 bp, Homo sapiens
ggggcggcacgagcaggatgaggaagtgcagggccatggacatggccacagccaccagcagccaggggttcatccagggcggcatccgcagcagcgactggttctccgagacg

SEQ ID NO: 2426 - DNA, 149 bp, Homo sapiens
agtgccaggcatgtagtgatgacagccgggaggccctcggggatggccgccaccgccagggccacggcgatcttgaagtagtagacagcgccacgcagccaggagccaccgtgggccgggtcggcgaagtggccgatgttgatgaccca

SEQ ID NO: 2427 - DNA, 25 bp, Homo sapiens
ttcaacagcgcaaggtcacacaggt

SEQ ID NO: 2428 - DNA, 100 bp, Homo sapiens
cggcactgacccaggtagaagctgcgatcaccagaggcttggaggccaacaaactacagctgcaagagaagcagacattcccgccgtgcaacgcggagtg

SEQ ID NO: 2429 - DNA, 28 bp, Homo sapiens
cagcggcagcggcgcatagaggagcaga

SEQ ID NO: 2430 - DNA, 154 bp, Homo sapiens
accggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctg

SEQ ID NO: 2431 - DNA, 35 bp, Homo sapiens
tggcaaaggggatgaggttgactccatcatcctgc

SEQ ID NO: 2432 - DNA, 111 bp, Homo sapiens
aaaagcacaactcttatccccagccaccccaaccctacccagcccagcggcccccagggccccgctaccccccatacactactcccccacgaatgagacggcagcgttctg

SEQ ID NO: 2433 - DNA, 133 bp, Homo sapiens
gacgaccatcttcacaggatagacaccaacccccaggcgccggggccgcggcacattgtatgtgatgcgaccactgctgttggtgatctctgtgtccaggtgtacccagcggcctgaggatggctctgccatt

SEQ ID NO: 2434 - DNA, 25 bp, Homo sapiens
taagaagagaagccgcggcccctgc

SEQ ID NO: 2435 - DNA, 101 bp, Homo sapiens
tctggtttatactgagcgatgatcgtgaccgtctgacccgcattcttcagggcaatggcagcctgctcatggctggcatttcggaggtccacaccgttgac

SEQ ID NO: 2436 - DNA, 39 bp, Homo sapiens
gactgtggccgctttctgtctaaccgagccctcaagcgg

SEQ ID NO: 2437 - DNA, 223 bp, Homo sapiens
gggcatcatgaccaccatcatggggttgtaggggagggccatgccagggggcggtccatagggatggagccctgggtgggctcggagattaggggcacccccagttgagcctctggatggaggagggcccccatcgctagtcccacttgcttccccaccccgccgaaggctgccccctcggctggagggctcagactcactgccactgccggacttggactcg

SEQ ID NO: 2438 - DNA, 146 bp, Homo sapiens
cccagtacgggagagaagcaaaggggaaaaagcacggatctgcgagggtggcggcggggggcgggccgcggggtgcgactcaaagccccggtctcagcggccgccgcgcgccaccgccaccgacgccgcgagcttcctccaggtac

SEQ ID NO: 2439 - DNA, 59 bp, Homo sapiens
gggtatttctttcggatcttctcgccctcagagcggcgcttctcgaacggatgctcttc

SEQ ID NO: 2440 - DNA, 81 bp, Homo sapiens
gagattgctcccactcacctgcggggcgccctggggacgctcaaccaactggccattgttatcggcattctgatcgcccag

SEQ ID NO: 2441 - DNA, 236 bp, Homo sapiens
ggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagccc

SEQ ID NO: 2442 - DNA, 25 bp, Homo sapiens
tgaggtgtccatgaacaaagtcaca

SEQ ID NO: 2443 - DNA, 170 bp, Homo sapiens
gaattcgaggccagaaggcacccctggcagtggcaagaagggggcagcagaccccaaggccacggggccaggcgaggggaagagggcgaagccgggagctggggcaggtacctgggcgggcactggcgcctgcccgggcccaggatgtagcgccggctccgggtacccag

SEQ ID NO: 2444 - DNA, 147 bp, Homo sapiens
gggagattatccacaagccctctcggctaatccagcctccaggcgatcctaggggagggagggaaggacagcgccaggaagtcatcttctacctcatcatccgccgcaagcctctcttctacctggtcaacgtcattgccccatgca

SEQ ID NO: 2445 - DNA, 87 bp, Homo sapiens
catggtagtggaccgcctcttcctgtggactttcatcatcttcaccagcgttgggaccctagtcatcttcctggacgccacgtacca

SEQ ID NO: 2446 - DNA, 37 bp, Homo sapiens
caatagtttcttctatgataaactccgtaccaaaggg

SEQ ID NO: 2447 - DNA, 87 bp, Homo sapiens
actggctacctcgcgcctgctgctgttgctgctgttgctactactgcgtcacacccgccagggatgggccctgagacctgttctccc

SEQ ID NO: 2448 - DNA, 254 bp, Homo sapiens
taccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgatta

SEQ ID NO: 2449 - DNA, 27 bp, Homo sapiens
gtacggggcggccttcagcgccgcacc

SEQ ID NO: 2450 - DNA, 64 bp, Homo sapiens
agcccgggcggagaagaagggcagagagcgaacataggagtccagtcgggagcgaaagagctca

SEQ ID NO: 2451 - DNA, 63 bp, Homo sapiens
gctggaaccggcatgaggctgagcggacagaggttctcaggggacttcaagaggaacaccagg

SEQ ID NO: 2452 - DNA, 57 bp, Homo sapiens
gaaaggccattccctgaggaagatcctggacctgacggggagggcctcctaaagcaa

SEQ ID NO: 2453 - DNA, 57 bp, Homo sapiens
agaaattcccaggggatcagcacatagctatccgcccagcaaccaagacggccttct

SEQ ID NO: 2454 - DNA, 33 bp, Homo sapiens
tgatacggcagaagacggacttctcctgggtaa

SEQ ID NO: 2455 - DNA, 31 bp, Homo sapiens
ggctcccatgggcacggaagcggggaacttt

SEQ ID NO: 2456 - DNA, 80 bp, Homo sapiens
atgtggctgtttggttgccccttactgctggatgatgttgctcgggagtcctggctccttcctggctccaatgacctgct

SEQ ID NO: 2457 - DNA, 190 bp, Homo sapiens
ccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtg

SEQ ID NO: 2458 - DNA, 88 bp, Homo sapiens
atctggatcttcgagttggaaaggaatgtatccatccccataggctggagctatttcattggttggctggtgcttatcctatacttca

SEQ ID NO: 2459 - DNA, 37 bp, Homo sapiens
gccttctgcggcaggcggacagatcctcggcgcggca

SEQ ID NO: 2460 - DNA, 93 bp, Homo sapiens
caggccgactgatgtatgtcattaacaatgctcacaggatcggcgtcaccgccatcgccaccaccagtgactgtaaaagggtcatcagtggcg

SEQ ID NO: 2461 - DNA, 24 bp, Homo sapiens
ggttcccaagtgacagtcagtgtc

SEQ ID NO: 2462 - DNA, 28 bp, Homo sapiens
ttcttagcacctttcttcgcgctgctat

SEQ ID NO: 2463 - DNA, 24 bp, Homo sapiens
gaagcccaggatgtcaatggcact

SEQ ID NO: 2464 - DNA, 102 bp, Homo sapiens
cttcctctagggaagtctgtagttcactcttctcatgatcaagttgtttctttactttctccagttcatggatatgctttccaccctctgcaatttgctctg

SEQ ID NO: 2465 - DNA, 26 bp, Homo sapiens
tttggagaggttgacgttggattgtt

SEQ ID NO: 2466 - DNA, 386 bp, Homo sapiens
ggcgcagccacacacgacctcggtcccgtacttcgcgcgctctcctgcaccgccgccgccatctcgctcaggagctcctccacaaccgccggcaacactacggccatcgcgccgcaggacacgccctccacgaccggcggaccgccgcgacgctccagctgactgcgcctacctgtggaggatcctgaccccccgccggggcagggcgagacggagtgacgtcggggcgcgtcatcgcgcgtgcggacgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcc

SEQ ID NO: 2467 - DNA, 29 bp, Homo sapiens
tgaatgaggtgatgggtccccttcctctc

SEQ ID NO: 2468 - DNA, 63 bp, Homo sapiens
actgggcttcatgggagcagacgctgcctacgctgtgtgaggacccgtcaggggcaggtgtcc

SEQ ID NO: 2469 - DNA, 36 bp, Homo sapiens
catggcgaagagcgcgcggaacatctggtccaggct

SEQ ID NO: 2470 - DNA, 26 bp, Homo sapiens
ccgtgcgatgcccgcgcaggggcggg

SEQ ID NO: 2471 - DNA, 26 bp, Homo sapiens
cgcatccaccggtcactcgccagcca

SEQ ID NO: 2472 - DNA, 70 bp, Homo sapiens
agcaccaagtacagtccgcagcgggtgggcctgacccacaccatggagcatgaggacgtcatccagatcg

SEQ ID NO: 2473 - DNA, 26 bp, Homo sapiens
caggcagccgccgaggcttttccagg

SEQ ID NO: 2474 - DNA, 56 bp, Homo sapiens
cttgctcggcccacgtggccagtgtccccgccaagctgtgggcccgcattgtgagc

SEQ ID NO: 2475 - DNA, 35 bp, Homo sapiens
ttgaggatgaagcagaactcggagttgaggaggct

SEQ ID NO: 2476 - DNA, 75 bp, Homo sapiens
ttgtactgccccagatcgtaactggagttgcagccaaccttgtcaatgccctcgccaactatctgtttctccatc

SEQ ID NO: 2477 - DNA, 58 bp, Homo sapiens
gcgaaggccccgtgtcccacgagatccctcttgctgtactcgaagtcacccaccacct

SEQ ID NO: 2478 - DNA, 25 bp, Homo sapiens
ggttcaggctcagattctcggatga

SEQ ID NO: 2479 - DNA, 38 bp, Homo sapiens
ggaaggacacatacgtggtgatcttccgccgcagcttg

SEQ ID NO: 2480 - DNA, 61 bp, Homo sapiens
acacaaatatagtttctacgacaacaggccaggtcagagtgaagcctaatgaacaaacaaa

SEQ ID NO: 2481 - DNA, 62 bp, Homo sapiens
gaggtggaaggatcgcttgggcccaggagacagagggtgcagtgaactgtgctccagcctgg

SEQ ID NO: 2482 - DNA, 92 bp, Homo sapiens
agcctcagcgacctcatattgcatggagctctttctttataaatgtttgcctaaggtgattcctatgtgtttcaaagggtctgacgtttcat

SEQ ID NO: 2483 - DNA, 79 bp, Homo sapiens
gcatccacaggctgacatggaccgtggaggggtggcactgtttaagcagcccagcacaccactttctggtgtggtggct

SEQ ID NO: 2484 - DNA, 29 bp, Homo sapiens
tgggcggcggcacccaaacaccaaggtca

SEQ ID NO: 2485 - DNA, 34 bp, Homo sapiens
agctgctccgtccgcagggtgtaacaggcctcca

SEQ ID NO: 2486 - DNA, 78 bp, Homo sapiens
actgagcgatggagcgtgggtagggagggtccacagtgtccactcgccgtgtgcgaagattgactcggtagtacttgt

SEQ ID NO: 2487 - DNA, 69 bp, Homo sapiens
tgccgttgctcgactctaaccgcttggaggcgcagtgcatcggggctttctacctctgcgccgaggctg

SEQ ID NO: 2488 - DNA, 113 bp, Homo sapiens
aattggtggccataggctggcagttggagtccagctggcctgccagggcctcctggagcactttggtctctgtctccgcacgccgaagtgagcgggtaaggtgggtcacctcc

SEQ ID NO: 2489 - DNA, 25 bp, Homo sapiens
gacccggacacctgcctctatcaat

SEQ ID NO: 2490 - DNA, 61 bp, Homo sapiens
aagatctctgggacgccattgtgattggggcggggatccagggctgcttcactgcatacca

SEQ ID NO: 2491 - DNA, 74 bp, Homo sapiens
ccatggacaaagccggataatccgaaaggcgtacctggaagacttttacacccggatgatgcatgagtgctatc

SEQ ID NO: 2492 - DNA, 101 bp, Homo sapiens
cgggttcaagctggcccctgtggtggggaagatcctgtatgaattaagcatgaaattaacaccatcttatgacttggcaccttttcgaatcagccgtttcc

SEQ ID NO: 2493 - DNA, 36 bp, Homo sapiens
gctcccgcttctctcgcagaaccttctgcttgtcct

SEQ ID NO: 2494 - DNA, 34 bp, Homo sapiens
agggaggccatctcggtcacagccaaatggatct

SEQ ID NO: 2495 - DNA, 90 bp, Homo sapiens
cacgtccaggatgttgcgcttcgtgacccggagctcgcggtgcttggggggcacatagccgtccctcagcgaaatgagcacgggttcggc

SEQ ID NO: 2496 - DNA, 87 bp, Homo sapiens
atcaacttccggctgaggcagtacatggacaagattatcctcgccatcctggaccacaatccctccatcctcgagatcaaacactaa

SEQ ID NO: 2497 - DNA, 24 bp, Homo sapiens
catttgcagcttacgtttactggt

SEQ ID NO: 2498 - DNA, 57 bp, Homo sapiens
ttacatgaacataccaccctagtaaaggcaagttctgtaagcttacattgctatttg

SEQ ID NO: 2499 - DNA, 24 bp, Homo sapiens
acctcactgaatgggtggatggct

SEQ ID NO: 2500 - DNA, 161 bp, Homo sapiens
gggccccttggagatcttgcagctggactttgaaatggagaacttcaccagccagtcagtcaagcggaggatcatgtggcacattgactaccgtggccacggcgccctgcctgacctggagcgggcagtcactgagctgacggtcattcagcgggatgtgc

SEQ ID NO: 2501 - DNA, 113 bp, Homo sapiens
ctttctggaaccttgtgggctctgccttcacattggtcttaggtgcctcatatacagagagaaccttgtttttcagcttgttttggatccagggatcaattgaggcacaaagg

SEQ ID NO: 2502 - DNA, 87 bp, Homo sapiens
tgtttccatgctgggagttacttgtttttgaagaagcaggcaactcttggaaatcactgaatgagtcatcaagggatcctgacttag

SEQ ID NO: 2503 - DNA, 70 bp, Homo sapiens
tggggttggagctagagctggcagcagagctggagccaaggtggaggtgggagatagcatccttggctct

SEQ ID NO: 2504 - DNA, 26 bp, Homo sapiens
gtcattgccgggttggacccgaagac

SEQ ID NO: 2505 - DNA, 80 bp, Homo sapiens
gattgatggtgtcagcatccagagcgaccaactgaagggtccgggccagctcgaagattcgctcgatttcactctgcacc

SEQ ID NO: 2506 - DNA, 89 bp, Homo sapiens
gaggctcgcctctagtgtcctccgctgtggcaagaagaaggtctggttagaccccaatgagaccaatgaaatcgccaatgccaactccc

SEQ ID NO: 2507 - DNA, 101 bp, Homo sapiens
accatgtcttcaactgtctctgcaatgagggacagtgctggggtgtcggcttgaatggtttcagctttcctccgaatagccctcatcgtcacagggatgga

SEQ ID NO: 2508 - DNA, 97 bp, Homo sapiens
gttgtcctcgttatggagaaagaagacaaacagaaagcgactgggggaaacgctgtgtggacaagtttgacattattgggattattggagaaggaac

SEQ ID NO: 2509 - DNA, 192 bp, Homo sapiens
agcggcgcagaccgtagccccaatgcgggcgcagcccctgactcggccccgggccaggcggcggtggcttcggcctaccagcgcttcgagccgcgcgcctacctccgcaacaactacgcgccccctcgcggggacctgtgcaacccgaacggcgtcgggccgtggaagctgcgctgcttggcgcagaccttc

SEQ ID NO: 2510 - DNA, 51 bp, Homo sapiens
ccactgcccactgactgctgccatgagcagtgtgctgccggctgcacgggc

SEQ ID NO: 2511 - DNA, 86 bp, Homo sapiens
atgtcttcgcggtgtctcttcttctggcgggtggacgcctgtcccttgtgggaggagtaggaactgagggcacaccacacggccag

SEQ ID NO: 2512 - DNA, 71 bp, Homo sapiens
ccacttgtagactcccaggggggctcccattatagaaggaggaggaggatgacgacgaggaagatgaggaa

SEQ ID NO: 2513 - DNA, 134 bp, Homo sapiens
tattgctaataccctggatctcacagatagaattctacctaggcttcaagctagagaaaaatgtaagccacagctgttgaacttcccaccttataccagaaatcagatagtcactattttgcaagatcgactta

SEQ ID NO: 2514 - DNA, 170 bp, Homo sapiens
cgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgc

SEQ ID NO: 2515 - DNA, 76 bp, Homo sapiens
gtttgaagagtgcgtttcatctcgataagctcattccgggctgaggtggtggcgccagcgtcgtcagagatctgct

SEQ ID NO: 2516 - DNA, 25 bp, Homo sapiens
ctcgcgggaagaataggattggcca

SEQ ID NO: 2517 - DNA, 75 bp, Homo sapiens
ctgctgcatgacgctgtccttggggtcgaagagcatgtagctggcggcgctgcgggcagcctggcgcacatcatt

SEQ ID NO: 2518 - DNA, 86 bp, Homo sapiens
cccgagacccgagagaaccactgacccctgcgccacgctgggcccgaggggagcccggggctcgctcgggcgcgcgtgtgaggcgg

SEQ ID NO: 2519 - DNA, 102 bp, Homo sapiens
agacatcacagagcgtgtacgatggccgctttctttctcgcttgggcttaggtggttctgggggccgagggaggcactcagcagctccagatatgggggtct

SEQ ID NO: 2520 - DNA, 98 bp, Homo sapiens
tgcgcctgtggcagaggttgtactgtttgcaaggctgttggctgtgctcctgcagctgggggcagcagttctggggtgacatgatgcaccacgtgtcc

SEQ ID NO: 2521 - DNA, 71 bp, Homo sapiens
cagccgccccggacgacaacagcgcgggcggcagcagcagcagcagcagcagtagcgtcacggcggcccag

SEQ ID NO: 2522 - DNA, 79 bp, Homo sapiens
ctccgcatctggtccagcgcagtgagcatctgttccagctgctgcatcttctgcctggtcactgactggttgtttccat

SEQ ID NO: 2523 - DNA, 88 bp, Homo sapiens
gtggctgcagtctgtagaaggcgtgattcttcccacaggcaccgggccacaatccgggcaatctccattggcttctcaagatacctgc

SEQ ID NO: 2524 - DNA, 48 bp, Homo sapiens
cgctgtcgctcttgtccaccagcacggcgtccgactcctcggtgatct

SEQ ID NO: 2525 - DNA, 99 bp, Homo sapiens
cagcaccagcacgccgttcacctggtccgacttgatcagctcttctgagccggcccccgacggctcctccgctgcctgagccccagcggaggaaggctc

SEQ ID NO: 2526 - DNA, 29 bp, Homo sapiens
ccagccctgtgacaagggttcctgtccag

SEQ ID NO: 2527 - DNA, 24 bp, Homo sapiens
ccaccctcaaggccagggtgtggg

SEQ ID NO: 2528 - DNA, 37 bp, Homo sapiens
cgccagggcgcgcagcgtgtcgtcgggtgggggcggc

SEQ ID NO: 2529 - DNA, 177 bp, Homo sapiens
gtgggagtcgatggccacagcacaggcaccagcccccggacagtgcacggtacacagcagctcctgccgttggctcaacgcggaaatctccgccagcgagggcaccagctctctgccgcgcgtccggcccagcgctttccggatgaagcgcgcatattccgccagttccgagtccgg

SEQ ID NO: 2530 - DNA, 202 bp, Homo sapiens
gtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcaga

SEQ ID NO: 2531 - DNA, 48 bp, Homo sapiens
tggcgatgagtttcgagtggccgtggcagtatcgcttcccacccttct

SEQ ID NO: 2532 - DNA, 25 bp, Homo sapiens
gtgtcccgtcccagcagatggtgaa

SEQ ID NO: 2533 - DNA, 179 bp, Homo sapiens
tgcttgtcaatcgctagcccggctcttaaagcggcaaggcctctccgcgagggggcggaggtccggaggagaggggaggtgaggagaacgcggaggccggcacaactcggaggaagtagtctttcccagcagctggtacgggggcagccaggtagtggtttgggagacaccgcacagac

SEQ ID NO: 2534 - DNA, 88 bp, Homo sapiens
cagccctctcagcgtacagcatgagctggctgaagcagccccaaaaggggcagcgtgtgagcagcaccgaacccaactgcatgatcag

SEQ ID NO: 2535 - DNA, 27 bp, Homo sapiens
tccaagtgggggcaccgacgacatatt

SEQ ID NO: 2536 - DNA, 32 bp, Homo sapiens
agcagctggacacaagggtccgccaggagcca

SEQ ID NO: 2537 - DNA, 49 bp, Homo sapiens
tgaggagacgtaggagcggcgagcagcggaggtgatgcgtctcctctcc

SEQ ID NO: 2538 - DNA, 86 bp, Homo sapiens
ccatgcagaatccttcgtgagtggaggtattccagaccctccagggcctggcccaggtagtacagggcccggtcctctgggagaca

SEQ ID NO: 2539 - DNA, 60 bp, Homo sapiens
agaggtgctggaagagcatccgcagagtgtcgtggttgggagcgggcagcgagcgcacca

SEQ ID NO: 2540 - DNA, 61 bp, Homo sapiens
aagctggccgctcagaacatggccaaggagcgtgaagggattgctccactttaccaccact

SEQ ID NO: 2541 - DNA, 37 bp, Homo sapiens
cctggtgtccacggtagagggtatgccgacgatctac

SEQ ID NO: 2542 - DNA, 32 bp, Homo sapiens
gcagctggaaggggatcgtggccctgagcggc

SEQ ID NO: 2543 - DNA, 69 bp, Homo sapiens
agcccgccggagccaccgttcctgctgctgccgccgctgcccgaatcggaaccgtcgggccgcagccgc

SEQ ID NO: 2544 - DNA, 38 bp, Homo sapiens
cctgtgatttctgtcattatactcttctccccagtttg

SEQ ID NO: 2545 - DNA, 37 bp, Homo sapiens
caaagaactggcttgccttgcccgtcttcacctcctg

SEQ ID NO: 2546 - DNA, 160 bp, Homo sapiens
tgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgccc

SEQ ID NO: 2547 - DNA, 34 bp, Homo sapiens
tcctccagaacccgacgctgtgcagtctcctttt

SEQ ID NO: 2548 - DNA, 129 bp, Homo sapiens
tgccgttgaagcgcaccacgacgtccagcttccggtcctgcaggccggcgcgctcctgcctcagcagccgccgcgccgcgctccttgtcgccgcctgcgcgctggggcgctccgttcgaacagcttccg

SEQ ID NO: 2549 - DNA, 32 bp, Homo sapiens
tgtagccggagtggggcttagcaaggatgtaa

SEQ ID NO: 2550 - DNA, 321 bp, Homo sapiens
ttttccgacaggtagagccagcgcaggtccttggctccctggaaggcgcctgcgcgcagctcacggatcttgttgttgttgagctgcaagatgaagaggttgaccagcggggagagcaacccccggggcagctcagtgaccttgttgtggtccaggtagaggtaggtcagctcggtcaggtcgtcgaaggcacctgcgcgcagcacgcggatgtcgttatgggacaggtacaagtagataagttgcttgaggccgcggaaggcaccggcggccacctcgcggatctggcagtgctgcaggtgcaatgacacgaggttcggc

SEQ ID NO: 2551 - DNA, 69 bp, Homo sapiens
ggcccatggacgatttatgccccagggggctggaggccacacccgggaggctcggatccagacactgga

SEQ ID NO: 2552 - DNA, 49 bp, Homo sapiens
ctgtgacctcgccacagtggccctcagccctccacctccggcgggggcg

SEQ ID NO: 2553 - DNA, 47 bp, Homo sapiens
tggggctgacccttggggagcctccctggagacctccgacacacctg

SEQ ID NO: 2554 - DNA, 34 bp, Homo sapiens
gagtgctggtgacgcacggcattagcttcctgcc

SEQ ID NO: 2555 - DNA, 125 bp, Homo sapiens
atcacggcaactgaagcggctggaatcagtcagccgctcacctatctactcccacttttcggagacagtgactggtgccagtgtcatccgggcctacaaccgcagccgggattttgagatcatca

SEQ ID NO: 2556 - DNA, 28 bp, Homo sapiens
gctgctacccctacatcatctccaaccg

SEQ ID NO: 2557 - DNA, 38 bp, Homo sapiens
ctgccgcccatccgctattcccacgccggcatctgccc

SEQ ID NO: 2558 - DNA, 39 bp, Homo sapiens
ataccatggatttttctccgagaagtggatactttgcct

SEQ ID NO: 2559 - DNA, 29 bp, Homo sapiens
actgcaaccctgctcagtgctccgggcgc

SEQ ID NO: 2560 - DNA, 27 bp, Homo sapiens
caaaggggcagccttcagatccaagtg

SEQ ID NO: 2561 - DNA, 163 bp, Homo sapiens
tccatcgtgcatcttaagggctccaatcgtcaaaaataggaaaaaaaaaatctttggaatagccaattaagttgaataaaaaaatccacacgaatgcggtttggttggggcaggaatccactcctatgttcctggtaatctgatcccgctccatgaatcctgg

SEQ ID NO: 2562 - DNA, 69 bp, Homo sapiens
gtgctctccgggaccaggccgagcgctgcagcgacaagtaccgcaccatcactggacggtgcaacaaca

SEQ ID NO: 2563 - DNA, 163 bp, Homo sapiens
tccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactg

SEQ ID NO: 2564 - DNA, 94 bp, Homo sapiens
gccgttgcgcttgaccccgggcgtccagccgtagggaagagagaagccgtcctcatactccgccggcagccagcgcacaaaggcacggttggag

SEQ ID NO: 2565 - DNA, 87 bp, Homo sapiens
gcaggcggaaagcctggagttcctgtgccaggaggctgaactgctcggtttggctgcggcactgttcttcgagctctcgaacccggg

SEQ ID NO: 2566 - DNA, 106 bp, Homo sapiens
agcgtctcccgctggttgcgcagcgcgatctgcctctgcagccgcagcacctcccgctgggactcgcgcagcagccgatcgaagtcccgcacgtggagccactggg

SEQ ID NO: 2567 - DNA, 97 bp, Homo sapiens
gacgtgagcgggttccggttgtctggagcccagcggcgggtgtgagagtccgtaaggagcagcttccaggatcctgagatccggagcagccggggtc

SEQ ID NO: 2568 - DNA, 35 bp, Homo sapiens
cgtagctgaggaatccgatccgtgactccttggca

SEQ ID NO: 2569 - DNA, 47 bp, Homo sapiens
ccagcggtggcagcccgagaggctcgcgaccctctcccggacgccgg

SEQ ID NO: 2570 - DNA, 26 bp, Homo sapiens
gctggagactagcgttaaccggcggg

SEQ ID NO: 2571 - DNA, 25 bp, Homo sapiens
tgatggcattgtggcccacttccct

SEQ ID NO: 2572 - DNA, 62 bp, Homo sapiens
cggggctgcacgtctcggcactgggcccgcacccgcccgccgcgcatctgcgctccctcaag

SEQ ID NO: 2573 - DNA, 86 bp, Homo sapiens
agctgaccgcgaactcctgcgtggggtgctcctggggcgggaggggcgcgctcagcctcgctctccccgggactctcacgctcaag

SEQ ID NO: 2574 - DNA, 38 bp, Homo sapiens
gacctgggcgagtgactcgttgtgtgctgtgcccgcag

SEQ ID NO: 2575 - DNA, 26 bp, Homo sapiens
tgacagtcacccatgggacaagcagc

SEQ ID NO: 2576 - DNA, 164 bp, Homo sapiens
gacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtc

SEQ ID NO: 2577 - DNA, 37 bp, Homo sapiens
ggcctcatcatccgggccaggacattcagtaagtctt

SEQ ID NO: 2578 - DNA, 74 bp, Homo sapiens
aggtctcggcgctgggaacggagccattcctggatgaagtcctgggggtcggtgctaaaactgagcatgaaatc

SEQ ID NO: 2579 - DNA, 45 bp, Homo sapiens
tggctatgaaacgtgggctctgccagatccgcgaacaagcactac

SEQ ID NO: 2580 - DNA, 35 bp, Homo sapiens
gcaaccccctcgtgtaccattgagggagaggcata

SEQ ID NO: 2581 - DNA, 197 bp, Homo sapiens
agttgaaattctcgacgccggtcataggcattctgtatgccgctgtctgcccataatgctcttatagcaggaagatattgtaagaaaacccttgtttccaccattccttgggctgccatgggggcccgggtatcaaacgacatcatcttatctccatgttgttggtttgagttgtctccccagggaatatgaagctt

SEQ ID NO: 2582 - DNA, 67 bp, Homo sapiens
gggctgtactgatactccaggctacaaccaccctccttgtccagcgtgtccacagggtgatggacca

SEQ ID NO: 2583 - DNA, 74 bp, Homo sapiens
caattgcactccattcttccgccttccttgttttctccaaaaccacctgataggggggatgtcctgatttctga

SEQ ID NO: 2584 - DNA, 194 bp, Homo sapiens
agatttcccagtgcactcaggagatcgtcggtggccttgatgaagccagtgctttttgggaaaaacggagcaaggcaacgcacgacagaagcggtgcaccaaggagtaaagattcagttccatgggccccacttgctgtttgagaaaatgtcctgcttccttcctagctgacttgactcccagcagtaacaggt

SEQ ID NO: 2585 - DNA, 25 bp, Homo sapiens
ggcccaagtttgttgacacacactg

SEQ ID NO: 2586 - DNA, 82 bp, Homo sapiens
gccgcaggcggcgcccccacagcagccggcggcacccccgcagcagccacaggcgcacacgctgaccacgctgagcagcgag

SEQ ID NO: 2587 - DNA, 24 bp, Homo sapiens
tggtatgtacagtccttcctgttt

SEQ ID NO: 2588 - DNA, 112 bp, Homo sapiens
gcgtggactacatcgctccctggtgggtcgtgtggctgcacagcgtcccgcacgtcggcctgcgcctgcagcccgtgaacagcaccttcagccccggcgacgagagttacca

SEQ ID NO: 2589 - DNA, 25 bp, Homo sapiens
tggcattgttgctgcttctgttggt

SEQ ID NO: 2590 - DNA, 30 bp, Homo sapiens
gccaagagtgaggcggccaccaaaagcagc

SEQ ID NO: 2591 - DNA, 353 bp, Homo sapiens
gagcctccgctgatgctgaggatgggcacatgggtctgggaggagatgaagtcaaggatctgggccaccgcctcggtgtccacgttgtcctcaaagacaatgccgtggacgtgggcagcacccaggaggccgcagatctgggtgaggaggctgctggggttggtggtgttgaccccaactgtgagcggctggatctccaggggtaggtccaggaagctctggggggtgaggcgggcacggaactgggcctggggcggccctgagctgctaaacaccacagccaccgtcatgccctgctcgccctgccccggacccagccctgcccaggcaccgaagagcgaggtgagcaacag

SEQ ID NO: 2592 - DNA, 98 bp, Homo sapiens
gctctacctgggcaccgagagtggcaacgtgtttgtggtgcagctgccagcttttcgtgcgctggaggaccggaccatcagctcggacgcggtgctgc

SEQ ID NO: 2593 - DNA, 42 bp, Homo sapiens
cggcaactggcgttcacatcgagccgccgtggggtgcagcct

SEQ ID NO: 2594 - DNA, 51 bp, Homo sapiens
atatgtttgatccccatggctggtctgaggactcctactatgaggcattag

SEQ ID NO: 2595 - DNA, 111 bp, Homo sapiens
gctgcctatggcacccacctgagcccacacgtgccccaccgcgtgctaagcacatcctccaccctcacacgggactacaactcactgacccgctcagaacactcacactcg

SEQ ID NO: 2596 - DNA, 150 bp, Homo sapiens
gccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccataga

SEQ ID NO: 2597 - DNA, 66 bp, Homo sapiens
tggtccaggcaggacagcgtcttctcaacattctcctgcagccgctgcagattctccgtctgcttg

SEQ ID NO: 2598 - DNA, 156 bp, Homo sapiens
tcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccc

SEQ ID NO: 2599 - DNA, 26 bp, Homo sapiens
aagctgagctcctcggcggcgtcctt

SEQ ID NO: 2600 - DNA, 71 bp, Homo sapiens
tcagcggttgcgtggagcccccgcccagctggaagccccagcagatgccaccgccagaagagcccttatga

SEQ ID NO: 2601 - DNA, 67 bp, Homo sapiens
atctggttcttcaagtcgtagaccttccccagccagcagtcataggcaatgtagtccccatacatga

SEQ ID NO: 2602 - DNA, 226 bp, Homo sapiens
acttctcgcagaagcggctggtgaaggggaagcaggtgaggtgctcgatccagggccagttaatggggtagatgtacagccacagcacgagggcggcgaagaggccggcaaaggccagcagtgacaccaggatgagtgcccgcttgcggtacttgtcgctggtgccgaaggtgatgtagggcaggaaggcgaaggccagcagcaggccactgaggaagccgaagat

SEQ ID NO: 2603 - DNA, 125 bp, Homo sapiens
ctcttgcggcgtggcaggtgggagtagccagaacggacactggtgaaggaggtgagggacaggactccgggggtcagcggtgggtgcggggcgtggggcctgtccatctcctccgggtggcggaa

SEQ ID NO: 2604 - DNA, 134 bp, Homo sapiens
agcatgctgtcctgctcgccaggggcctgggtctctttctcgggtggcgggatggtgatggagaggttgggtggcttccggctctgcaggcggctgctggacacagaggacacgctcccgccattcttgtcagc

SEQ ID NO: 2605 - DNA, 166 bp, Homo sapiens
tcgagtctgagtttgcccgcggcttcctgggtcttgctgtgaagggctttagagcatgttcttgtcttctccttgctctgtacagatgctccggtgtcaagcctcagtctgtggaagggtggctggacagacaggtggctggaaggacagatagacagctccaggc

SEQ ID NO: 2606 - DNA, 129 bp, Homo sapiens
ccgcggtcggtgtcatcggagcgggcccctggggtgccggagccggaggagctgtgggaggcagagatggagcggctgcgcggctctgggacgcccgtgcgcgggctgccctatgccatgatggacaag

SEQ ID NO: 2607 - DNA, 68 bp, Homo sapiens
gcccctcgtcgatgcctatgacagccacgcccagggcctcctgggccacgtctcggagcaggcaggcg

SEQ ID NO: 2608 - DNA, 234 bp, Homo sapiens
gaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttc

SEQ ID NO: 2609 - DNA, 309 bp, Homo sapiens
accaggcttggcatggtctgaactggaaaccctgagaatgtttctgcagtgggacaggagggacgtcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcagaagcccacatatgctgtgacgctggccacctttt

SEQ ID NO: 2610 - DNA, 100 bp, Homo sapiens
gatgcgcctcagtgtctttttaaagaagcaagaagagagccagtttcaccctctggagtggttggcaagggaagcctgcaaccaggacgctctccaggag

SEQ ID NO: 2611 - DNA, 455 bp, Homo sapiens
gagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactg

SEQ ID NO: 2612 - DNA, 103 bp, Homo sapiens
cgctgctccggagctcctcggcgccgccggcggccacggacgcggcgcacatgtcggcgtccacgggcaccgaggtgcagatgaagcgcgtcggcccgaaatc

SEQ ID NO: 2613 - DNA, 80 bp, Homo sapiens
ggccttgttggtcacaggtcccgggctgcccatgctgagctcctgcagccacggccgggtgcggaggaggatgtgctcct

SEQ ID NO: 2614 - DNA, 56 bp, Homo sapiens
caggtagcccggacacgggacatcatcatcggacgtccccttcaggagaatcggga

SEQ ID NO: 2615 - DNA, 236 bp, Homo sapiens
gaccgccacgcacagggatacagggggcgcctccgcccggctaaaaagcgcggcctgcgccgccgccgccgcctgatttcgctcgggcttcgggtgacttcgccgcaggacctacccagctcgctcacttcgctcgctccgcgtcccccatgccagcccccaacgcagggcgcccggcgaagccacgggactggcgggaggagcacgcggggccggaggaaatcctgaagctgacc

SEQ ID NO: 2616 - DNA, 44 bp, Homo sapiens
agggagaggagcccgacatcgcagtccccaagttcaaacagagg

SEQ ID NO: 2617 - DNA, 34 bp, Homo sapiens
acaagaacccacacgtcgccttgtatgccctgga

SEQ ID NO: 2618 - DNA, 77 bp, Homo sapiens
ttcttccaagtactccaccatccccaagtttggcatcgagaaggaggtgcgcgtgtgtgagccctgctacgagcagc

SEQ ID NO: 2619 - DNA, 28 bp, Homo sapiens
atgcagaacgacgtgaagctgccccagg

SEQ ID NO: 2620 - DNA, 54 bp, Homo sapiens
cgtccacacggagcgcgtcttctgcctgggcctgccgcacgccgcggactgctg

SEQ ID NO: 2621 - DNA, 32 bp, Homo sapiens
ccagcacccggcggcccgcgaggaacagctcc

SEQ ID NO: 2622 - DNA, 33 bp, Homo sapiens
gctcggcctcctcgtcagtgacagatctgtact

SEQ ID NO: 2623 - DNA, 24 bp, Homo sapiens
cccagctctgcacggagcctgttc

SEQ ID NO: 2624 - DNA, 106 bp, Homo sapiens
gagaggtatcttgtcggcctgtgaggtcggacgaggagatgttgacgggggccccgcggtgcagccgcatactcactttccgctctctctccatgccggagacggg

SEQ ID NO: 2625 - DNA, 118 bp, Homo sapiens
ctgggtccgatacgccgagcgggtgctgggtcgccccatcactgcccacctctgcaccgccaagtccccccagcaggtcatgggctctttggtgaaggattatttcgccagacagcag

SEQ ID NO: 2626 - DNA, 33 bp, Homo sapiens
tgctgcataccacgtaccagagccaggagcgtg

SEQ ID NO: 2627 - DNA, 25 bp, Homo sapiens
catccttcagcgcctgggcacagag

SEQ ID NO: 2628 - DNA, 24 bp, Homo sapiens
acagcgccgaggtgcgccgagcag

SEQ ID NO: 2629 - DNA, 130 bp, Homo sapiens
gcaggtactggcaggagcgttcttgctgacacgactcggacttcaccatggcctggtccatgttcaccgaggccttctggtaaacctcccgggcccggctcacggtgagcgtggaggaccaggcgctctt

SEQ ID NO: 2630 - DNA, 65 bp, Homo sapiens
gggagatgtgggggcacaatgggtggatgggggtgacaagggacatgagtcagtgccaagcccag

SEQ ID NO: 2631 - DNA, 35 bp, Homo sapiens
agaaaaaaagtagcgcaagggcagagagaggtagg

SEQ ID NO: 2632 - DNA, 24 bp, Homo sapiens
ttttcatgctctggaaaggactga

SEQ ID NO: 2633 - DNA, 113 bp, Homo sapiens
ctccaggcccgagagaccagcaaaccgtcgccctccgtcccgttgggccccacattcccccactgcctcacagcctcagtcacccggagacccgacgtccttggaggagcatg

SEQ ID NO: 2634 - DNA, 70 bp, Homo sapiens
gcaggccgacccactctgtaggatcgataggagcgctgtagagcagagacttgttcaactcattaaaggg

SEQ ID NO: 2635 - DNA, 25 bp, Homo sapiens
ccccccggagtacttcagaatgcaa

SEQ ID NO: 2636 - DNA, 170 bp, Homo sapiens
cgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatgga

SEQ ID NO: 2637 - DNA, 157 bp, Homo sapiens
gctggcgcgagcagagcctgcgccggcggagaggctcaggccccgcacgatccggggagagcgctggcgctgcggcgcatgcgcgctgcgcgccgcgccccgcccccacgccaagccctgtcggccgtggggaaagtacctggagcgtcggacgtca

SEQ ID NO: 2638 - DNA, 25 bp, Homo sapiens
caaagaatctactccttaaacctgg

SEQ ID NO: 2639 - DNA, 33 bp, Homo sapiens
tggccttcagacagcgccgcaccgcggctgggc

SEQ ID NO: 2640 - DNA, 78 bp, Homo sapiens
gagaagggcttcgaagataaactgagctccattcccctggcatgaaactttcagattcccctgcctctagaaattgtc

SEQ ID NO: 2641 - DNA, 58 bp, Homo sapiens
tgtcacccgggatgatgatgtactttgtgttactgaatattcccgtattgtacctttg

SEQ ID NO: 2642 - DNA, 262 bp, Homo sapiens
attcgggcatacatgcagaccaggtggttttcagcatgttcaaagaacaaagagatggttagaggttttataaacagggaagtgatactggttgctctttgagaaagtttatcggcactagtaaagtcttggggaggtagcaggttttgatcggtgagtgagggagtgagcaaaacacagtgggtgtttcagtagccgttagataaaactggcttctggatacagcaggaaatttcagcaactaggcttacagagaattcca

SEQ ID NO: 2643 - DNA, 24 bp, Homo sapiens
ggccggactcggggccactgtcca

SEQ ID NO: 2644 - DNA, 66 bp, Homo sapiens
taaccatcgttttcgcatgtgccatctgtcaaagtctggaagaaacctaagatgtgttgcattaaa

SEQ ID NO: 2645 - DNA, 25 bp, Homo sapiens
agctgtggaccttcgcgggttcccg

SEQ ID NO: 2646 - DNA, 44 bp, Homo sapiens
tgtacctgatgcatgcatcattggatttatcctccccatgtttc

SEQ ID NO: 2647 - DNA, 454 bp, Homo sapiens
ctggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactt

SEQ ID NO: 2648 - DNA, 82 bp, Homo sapiens
agccagccgcagttgacagtgttacaattccaccagccccagtgttatctctccttgctgcatctgcagcaacgtcggatgc

SEQ ID NO: 2649 - DNA, 39 bp, Homo sapiens
ggcgcagccggcacttctgccggatcttgttggggcccc

SEQ ID NO: 2650 - DNA, 274 bp, Homo sapiens
tgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctact

SEQ ID NO: 2651 - DNA, 107 bp, Homo sapiens
atactgtctgtcccgttggcaggaggcgtacaggaagaggtgctgtaatggtttgtaccactacgatggaaagtggacatcggaggaagactggaattgatgtctgc

SEQ ID NO: 2652 - DNA, 24 bp, Homo sapiens
ccagcgcctgtccggcaacgtcag

SEQ ID NO: 2653 - DNA, 67 bp, Homo sapiens
gccacaccagtcggtaggggttgcagtactccagcctttccatgactttttggacagtggcgcttac

SEQ ID NO: 2654 - DNA, 79 bp, Homo sapiens
agttagctgggtatggtggcatgcacctgtagtcccagctactcgggaggctgaagcaagagaatcacttgaatctggg

SEQ ID NO: 2655 - DNA, 83 bp, Homo sapiens
aactactggaaatctggctgggcgtggtggctcaagcctgtaatcccagcactttgggaggctaaggagggcagatcacctga

SEQ ID NO: 2656 - DNA, 24 bp, Homo sapiens
gaaggacaaggttgcccttttgat

SEQ ID NO: 2657 - DNA, 132 bp, Homo sapiens
cgctccgagctcaagcgctggataggctcaccaacaaacccgtggagcccgagtcggagtttgtcatcaaaattcaggatatcaacgacaatgaacccaaatttttggatggcccatacacggcaggagttc

SEQ ID NO: 2658 - DNA, 81 bp, Homo sapiens
ttcaatcagaacgggcccatggggtttcagcgcaacggtgacagcggcagcagtcttcagggcactaaaggttaagaggga

SEQ ID NO: 2659 - DNA, 90 bp, Homo sapiens
gaaagatgagaacatccctggcacggtcgttcggaccagcactatcccagaggaacttgggcgcctggtgtatttattgacagacaaaac

SEQ ID NO: 2660 - DNA, 96 bp, Homo sapiens
cagagcacggacagctatccggtcgtgggcgggaagaagatggtcctgtctggccacaacttcctgcaggactccaaggtcattttcgtggagaaa

SEQ ID NO: 2661 - DNA, 31 bp, Homo sapiens
tgaagcagtcggacgcgtctccccaagaaag

SEQ ID NO: 2662 - DNA, 112 bp, Homo sapiens
gctgtgaagtcgtcagaacacatcaacgagggggagacggccatgctggtctgcaagtcagagtccgtgccacctgtcactgactgggcctggtacaagatcactgactctg

SEQ ID NO: 2663 - DNA, 55 bp, Homo sapiens
cgagtctccaacacgcccctgaggacggttgacggctcccccatgatgaaggcag

SEQ ID NO: 2664 - DNA, 137 bp, Homo sapiens
cacaccattgtgcagccaggacagggccacaatggggtccccctccactaggctgcccactgagctctcccagctattagccaggtggtccgccatgctccagcacttgatctgcccgtcggcatctgctgacagga

SEQ ID NO: 2665 - DNA, 47 bp, Homo sapiens
cctcccagcgtcgcgccctaacgacccgcaagtgtccgagggcgcct

SEQ ID NO: 2666 - DNA, 41 bp, Homo sapiens
gcctcggccgcctttgccgcctactgaagccggcgctgctc

SEQ ID NO: 2667 - DNA, 139 bp, Homo sapiens
gcatatattagcaggggtctgccccacggagcccccgagacgcggggccctgagcacctggggtttcctgagtttctagctcttgggaccacccggtttcacggatttcaagggtttgggcccactgagcccttgtggg

SEQ ID NO: 2668 - DNA, 31 bp, Homo sapiens
cccggcgcacgcagccctcggggatcttgat

SEQ ID NO: 2669 - DNA, 90 bp, Homo sapiens
gttgaggcgctggtggacgtcccagcagcgcttgcagaggagcaggacgccagacaacaccaccagcgtgccccccacgaacagcgacat

SEQ ID NO: 2670 - DNA, 41 bp, Homo sapiens
gcgtccagtggcattgtcccacgacgtcgtcagggctactg

SEQ ID NO: 2671 - DNA, 43 bp, Homo sapiens
caagtcgtcagacaaccgatcccgtgggtaccgtggtggctct

SEQ ID NO: 2672 - DNA, 40 bp, Homo sapiens
gggcctcgtactgcctcatggaaaatcctccggagccgcc

SEQ ID NO: 2673 - DNA, 58 bp, Homo sapiens
gcgcaaggagatgcgcgtcctgcacgtgctggagcagatccgggcctactgcgagacc

SEQ ID NO: 2674 - DNA, 87 bp, Homo sapiens
ccatcgagccgcagatctgccaggccacctgtgctgttatgaagctgtcctttgatgaggagtaccgccgtgccatgaacgagctag

SEQ ID NO: 2675 - DNA, 214 bp, Homo sapiens
agtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacag

SEQ ID NO: 2676 - DNA, 79 bp, Homo sapiens
cagagaccacgatgccctggcctgacagcccctgactccaggcctgcaggatgctcaggtctggttgggcctcgctgtt

SEQ ID NO: 2677 - DNA, 30 bp, Homo sapiens
gcccttcccgttggtgacaggcagcgggaa

SEQ ID NO: 2678 - DNA, 33 bp, Homo sapiens
tcatgttgatgtcgttggcaccgtccccgatgg

SEQ ID NO: 2679 - DNA, 102 bp, Homo sapiens
ctcgtccccaaagaggtcggcgtggctcagggcccgcttcttcagcttgggggcgtcctgggaggcgccctcgtctagtgagcgggctttccgctccactag

SEQ ID NO: 2680 - DNA, 57 bp, Homo sapiens
cactcattcacagtaacggttctgaccagtcctccaggtcgcacgtggatgcgacag

SEQ ID NO: 2681 - DNA, 117 bp, Homo sapiens
cttctcggattcctccaggaacagtggagaagacaaggcaggaatcagctctcagaattccacaccaaggccttctgggctcccccggtcttcccacggacgagacacaagtgaccc

SEQ ID NO: 2682 - DNA, 73 bp, Homo sapiens
ttcaccaggaggcagacatggtggccctggatggagcggctgtacatggaggcgcaggagtccactcgctcca

SEQ ID NO: 2683 - DNA, 26 bp, Homo sapiens
tgcagactgccccggatgtcacaggt

SEQ ID NO: 2684 - DNA, 99 bp, Homo sapiens
ggtgcttgggacgccgctgctcctcctcgtggaagacggccctgggcctctcgtcctctgactcgctgtccgagagtggctcattgatccaggcgtcca

SEQ ID NO: 2685 - DNA, 25 bp, Homo sapiens
cccgcccgcgctgcagaagcttcta

SEQ ID NO: 2686 - DNA, 55 bp, Homo sapiens
tcttggggcccctcatgcccagctcggccgccatctcggccggctgccgggacag

SEQ ID NO: 2687 - DNA, 336 bp, Homo sapiens
cgcaccacgcggtaatacagggcgtccccgctctctgcgcagggtgagctgtctaggaggcggaagctgtggccggggtggcagggcccggggtggccccccatgagccgggcacggagccgggcatagatggtacggaggccctgcagctgccgcgcagccagtgcagtgtgcacagcctccgggctgtgcagatcgcggagggagaggcccagtggggcgtcagccgggccaaaggtcagctctgcagggagacaggctggtcccactgcagcctggctcttgtccacactgtgggaccccagaaagggtctccgaggcggctgtacttggatg

SEQ ID NO: 2688 - DNA, 102 bp, Homo sapiens
ctatggcgttggcctccttgtgacattcgtggcactggccctgatgcagcgtggccagcccgctctcctctacctggtgccctgcacgctggtgacgagctg

SEQ ID NO: 2689 - DNA, 52 bp, Homo sapiens
caacccaacccacgaggaccatcgggggcagagtcgttggagactgaagagg

SEQ ID NO: 2690 - DNA, 25 bp, Homo sapiens
ccacttcctcaaagatcacgcagtc

SEQ ID NO: 2691 - DNA, 49 bp, Homo sapiens
ggagagcctcgcattgtttgggactatcctggaactaccctggttcaaa

SEQ ID NO: 2692 - DNA, 26 bp, Homo sapiens
aggaagcgggcgaggtgctggagaac

SEQ ID NO: 2693 - DNA, 39 bp, Homo sapiens
ggaggaggcaagtttaactaccagggaaccaagcgctgg

SEQ ID NO: 2694 - DNA, 73 bp, Homo sapiens
gcggacgctccggcgcatgcagcagatggtgggccagctgggcatcctgacgccgtccctcacattgcccttc

SEQ ID NO: 2695 - DNA, 139 bp, Homo sapiens
aaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgt

SEQ ID NO: 2696 - DNA, 60 bp, Homo sapiens
tgggagctcctaaaccccgccacttccggaagactcctggcccgggattatgccaagaaa

SEQ ID NO: 2697 - DNA, 26 bp, Homo sapiens
tgccggcacttccgcacgatcgcaaa

SEQ ID NO: 2698 - DNA, 94 bp, Homo sapiens
atggggatgcaggcgtggtcctcctccaggtccttcaggcagatctccaggtgcagctcgccggcgcccgcgatgatatgctctcccgactcct

SEQ ID NO: 2699 - DNA, 93 bp, Homo sapiens
attagccccatgagcgagaggaagcccccgtaggaccagccatggatggcaactcggctcaggtcgatgaagccatacttctcggccacgaac

SEQ ID NO: 2700 - DNA, 66 bp, Homo sapiens
atcaagggaaacgatccttattgcctcaccatttcccacgtgaagtctgtattgacattctcatag

SEQ ID NO: 2701 - DNA, 314 bp, Homo sapiens
tctacagaaagttggagtggcgtctggtctttgacagagcaggggtttttgaccggctccagaataggcaaggggagagactgggggcctgcagacccctcggtgcactccactgggtagttggtgctggtttctggagctgcgggggtatcagggaggccagtggaggttgcatctggggccacttcgggaagcccaggaggtgggctgcttggcagctctggtgggctggcaatctcccccgatggcggccagctcatctcctcaggctcctggcagccaccggggacaggctcgggcaccaagctggcctg

SEQ ID NO: 2702 - DNA, 263 bp, Homo sapiens
aggtgtgttctgggccacatattccaccatgtggtccagggcctcgcgggcgctggcgacacgctcacggctctgggccagaatgctgctggacaggtcctggaaggagtggatgctggaaaacgtggcctggaggtcctccacctggcggcgggcctgctgcacctggtccttcacattggtggggaggccctgaatgctggaccccagggaggtacaggtggcctgcagttgctgggcaatgtcccggaacatggtgagcg

SEQ ID NO: 2703 - DNA, 60 bp, Homo sapiens
ggctccaggacagcgtgatgctggtctccgacctggcctcggcccgcaggttcatgggct

SEQ ID NO: 2704 - DNA, 242 bp, Homo sapiens
ttcaccgtgatctgagcaaccgcctcaatgacgcccaggctggacatggccacgcaggtgtagttggccgagtccttgacatctgtgagttccagcacgttccgacccacgggcatgtcatcctcgggggtcaggtcctcggccccctgcatccacttcacgtatggcatgggcgagcccacggccacgcaggtgatgttcacgttgccccctggcatgatctcgtggctcatgggcaggat

SEQ ID NO: 2705 - DNA, 301 bp, Homo sapiens
ccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttga

SEQ ID NO: 2706 - DNA, 129 bp, Homo sapiens
ccggatgcgatggagctgcgcgagctgacgccctgggctgggcggcccccaggtccgcgccgtcgggcggggccccggcggcggcgcgcgcgtgcgcggttgggggcgcggccttgcgggctgcgcgag

SEQ ID NO: 2707 - DNA, 27 bp, Homo sapiens
tgaccgcgtctgcctgtggatacacct

SEQ ID NO: 2708 - DNA, 123 bp, Homo sapiens
ccggcctcagcacgtcggggatgagaatctccaccagcgcctggtagaggatgtggtcgcagctcctcatccacctgaggatggggtcgcactgacacagggagataagcttgtccttgggca

SEQ ID NO: 2709 - DNA, 136 bp, Homo sapiens
ctggcatcactggcatcggacgacatctccaggtcgtcctccaggtcgtggatgcgcagctcgctcgccttcctgcggccacgtttctccttctcctcctcatcctcgtcctggtcctgatccttgagccgccgct

SEQ ID NO: 2710 - DNA, 25 bp, Homo sapiens
ctggggtgggtactggtgaggaggg

SEQ ID NO: 2711 - DNA, 79 bp, Homo sapiens
ggccagcccctggcgcaactcgtgcacgtccacgcggccatccttgttactgtccagctcctcgaacaggcgaccccag

SEQ ID NO: 2712 - DNA, 24 bp, Homo sapiens
taaccctcaaagcacttcttaaga

SEQ ID NO: 2713 - DNA, 136 bp, Homo sapiens
cgggagagcagattcccacggccagggtggtggggtggtgcctggaggccgtcgtggaggagcagatggccagcgtcacctggatgtgtaccatgtagatgccatcacgatggatacgtagctgccccttgtccag

SEQ ID NO: 2714 - DNA, 85 bp, Homo sapiens
ggccgcagagaacggaggtagctcttcaggtctccgtgagccatcagctccatcaccaccagcgtgggctggcccttggacacca

SEQ ID NO: 2715 - DNA, 120 bp, Homo sapiens
tccagagcctgatctgcaggcagctgggcagcgccaacggccaggcggaagacggaggcagctccacaggcccgcccaggagggctgagaccttcgcgggctacgactgcacaaacagcc

SEQ ID NO: 2716 - DNA, 107 bp, Homo sapiens
ggacatgcccgtcaagaaccagtactccgagctgctcaagatgtcctcgccgtgcgagaagctgatccgcagggacatcgcccgcacctacccggaacatgagttct

SEQ ID NO: 2717 - DNA, 130 bp, Homo sapiens
caacaggacagtttccctacaagaactgcaagacggactttgaggtcctcaccaaagtcctacaggaagagcccccgcttctgcccggacacatgggcttctcgggggacttccagtccttcgtcaaaga

SEQ ID NO: 2718 - DNA, 303 bp, Homo sapiens
ctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccag

SEQ ID NO: 2719 - DNA, 177 bp, Homo sapiens
aatctctgcgcctggtggtgaacggggcctccgaaccgtcgcgctggcgagtggtacagctgcgagaggagtgccacgtttttgttctggttggggttggctgcaaacttcactgtgatgggctcagaggaacctgggggtttatgaccattgaaactggtaattgcctcttctgcc

SEQ ID NO: 2720 - DNA, 24 bp, Homo sapiens
gcgcagtttcttgtcagttccccc

SEQ ID NO: 2721 - DNA, 27 bp, Homo sapiens
taggtgtagtgagccagacgaggcagc

SEQ ID NO: 2722 - DNA, 69 bp, Homo sapiens
gttactggttgcgtcgggtcacgtgggcgcgcaggcgcagcgcggtgcagcccgttcgctcacacaaag

SEQ ID NO: 2723 - DNA, 34 bp, Homo sapiens
ggcctcaaatgatccccccttcttggcttcccaa

SEQ ID NO: 2724 - DNA, 29 bp, Homo sapiens
ttatatgtttagtagagtcggagtttcac

SEQ ID NO: 2725 - DNA, 155 bp, Homo sapiens
tggcaggcctccagtacaggtgggcgcggctgcgggcatgcgctgtcgtccagcgccttctcctccgcggcagagacgcggcgctggcacacgaccgagcggctgcgcacgcctgcatcgcagctgcggctgcagagcgaccagttccctacaac

SEQ ID NO: 2726 - DNA, 120 bp, Homo sapiens
gagagaagtccactgaatacgctcacttgttcgaagtctttggcatggaccctcatctcactcagccaatgggaaggcacgctggcaagaggccctatcaccgccgcgactatggggtag

SEQ ID NO: 2727 - DNA, 66 bp, Homo sapiens
atacacctgagtgaggcaccccatgtaggagatgtctttgctccgtgcctggatgctcactagcat

SEQ ID NO: 2728 - DNA, 211 bp, Homo sapiens
gtggctgctgtcgtctggttgaaagacagctcctctccattggtgccaaggaagcgggcggagtggctgtagtcacccgtggcttcgtccagccaggcagctgcattctggcaggagtaggtgaagttctggcgagctgtggcactcagcagtttcaggaagttcagctgcacgacattcactggggacccgtcggcgtccacgtaggaga

SEQ ID NO: 2729 - DNA, 87 bp, Homo sapiens
gtgctcaccccaagagccggaagcagaaccacctgcccaaagtgctccaccccagcaaccctcacattagcagtggctccactgtgg

SEQ ID NO: 2730 - DNA, 50 bp, Homo sapiens
catctctgggatgttatcatcgacttcctcatcgtcatctgcctccttca

SEQ ID NO: 2731 - DNA, 67 bp, Homo sapiens
ttctatgccggctgagcgagaaaaagaggaatatgaaacaatctggggaaatggccatacatggtgg

SEQ ID NO: 2732 - DNA, 24 bp, Homo sapiens
gtgaccattaggcccggggctgag

SEQ ID NO: 2733 - DNA, 68 bp, Homo sapiens
ctggagggacgcggatgggcccaggttgttgagcagctgcaggatgttgggctcggggaggagtccct

SEQ ID NO: 2734 - DNA, 168 bp, Homo sapiens
ctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcag

SEQ ID NO: 2735 - DNA, 45 bp, Homo sapiens
tgctgtacctggaccctcactactgccagcccactgtggatgtca

SEQ ID NO: 2736 - DNA, 99 bp, Homo sapiens
cctggagaggaatgacggctcggccgagaggccttacttcatgtcttccaccctcaagaaactcttgaacaagaccaacaagaaggcagcggagtcctg

SEQ ID NO: 2737 - DNA, 84 bp, Homo sapiens
cgagacgtgcctggcttcgccatcgggggcctgagcgggggtgagagcaagtcgcagttctggcggatggtggcgctgagcacc

SEQ ID NO: 2738 - DNA, 26 bp, Homo sapiens
tctgggcgacgttgctggcagaggaa

SEQ ID NO: 2739 - DNA, 108 bp, Homo sapiens
tcacgctgacaagcagagccacatcctatgggccctcacaggccacgtgcagcggcagaggcgggagatggtggcacagcagcatcggctgcgacagatccaggagag

SEQ ID NO: 2740 - DNA, 103 bp, Homo sapiens
ggtcgtcggcgagcctccggccatcctcagcaggcacaacacgttcgtcctccaggtcacacttgttccccaccaggatgacctgggcgttgtcccaggagta

SEQ ID NO: 2741 - DNA, 82 bp, Homo sapiens
tgggagagcagcgcgagcacggtcagcagcaccaggatgaccacgaggatgagggagagcgtcaggatgagggggtccaggt

SEQ ID NO: 2742 - DNA, 89 bp, Homo sapiens
cacttgcatcgcccgcaaggcgcgctccagctggtccttggcctcggcgtgccgccgctcctccttcttgagacgctcctgcgcctcgg

SEQ ID NO: 2743 - DNA, 24 bp, Homo sapiens
tcccctggtttttgtactgctctt

SEQ ID NO: 2744 - DNA, 25 bp, Homo sapiens
caagttaacaaaggtttcttgcatc

SEQ ID NO: 2745 - DNA, 39 bp, Homo sapiens
ggcgctcaggttacgtccggaatcctctcctacggcaaa

SEQ ID NO: 2746 - DNA, 86 bp, Homo sapiens
gaggccgcacatgctgaagatcatgcccagcaggttcatgtagtccggcgtcgggtcgtccaaggccgggttacattcgctcggcg

SEQ ID NO: 2747 - DNA, 31 bp, Homo sapiens
agcggcggcaactcgcgctgcggcttctcca

SEQ ID NO: 2748 - DNA, 34 bp, Homo sapiens
gcagtccagctctccaaggggcgtgagagtgttc

SEQ ID NO: 2749 - DNA, 425 bp, Homo sapiens
ggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgc

SEQ ID NO: 2750 - DNA, 27 bp, Homo sapiens
aagaagcgcagctccctcttccggaag

SEQ ID NO: 2751 - DNA, 35 bp, Homo sapiens
tgcctgcagctcggccgcttgaaggaccaggacaa

SEQ ID NO: 2752 - DNA, 24 bp, Homo sapiens
gcagagctggccgcgccaaataat

SEQ ID NO: 2753 - DNA, 27 bp, Homo sapiens
ccaagcgccccaagtccatcgatgaca

SEQ ID NO: 2754 - DNA, 130 bp, Homo sapiens
taggctggctgttgggcatgtcggtaggggggccttgttccggactccatgtgcccgtcttctggaacatctcctgggcacgctgggtcacccaggacgggctctccttgaggccgctttcgtgagccat

SEQ ID NO: 2755 - DNA, 84 bp, Homo sapiens
ggaggggagggcgttctggccaggtcccccttcctgcgttggggacgggggctccatgcgctggaacatgaggggtgtccggtc

SEQ ID NO: 2756 - DNA, 45 bp, Homo sapiens
ccgcagcttcttcctcttagtcattttatcttccccttgagaaat

SEQ ID NO: 2757 - DNA, 53 bp, Homo sapiens
gctccctgaaggttctggcggacagcgagcgatatacgtggatcgtgctgtga

SEQ ID NO: 2758 - DNA, 72 bp, Homo sapiens
cctgctgggtaccatggaccgtcagggagacctggccacctttgctgcctggggctgcgctctgcaccacca

SEQ ID NO: 2759 - DNA, 29 bp, Homo sapiens
ggaggtgaagctgcatgcgggcggctccg

SEQ ID NO: 2760 - DNA, 25 bp, Homo sapiens
aggccaataacccctcggagcagga

SEQ ID NO: 2761 - DNA, 49 bp, Homo sapiens
tgcttcggaggaacccagagcggaggctgggatctagcgagagagatgc

SEQ ID NO: 2762 - DNA, 27 bp, Homo sapiens
ggagcccgccggcgagatctggtacaa

SEQ ID NO: 2763 - DNA, 69 bp, Homo sapiens
ggcagcggtccctcgggctgaggctcccaggctcctgcaaagaggttggccaggtaattctctaaatac

SEQ ID NO: 2764 - DNA, 106 bp, Homo sapiens
agtcgtaagtgaggtcgccactctgcctgcaggtgcccccgttacggcatggtgagggtgcacagggcaccgcggggttctcacatagtggccctgtgtagccagc

SEQ ID NO: 2765 - DNA, 127 bp, Homo sapiens
cggttccggttgtgatccatggtcttcagatgcttctggatgatcccaaactgcatgggaatgaagaggtcgcaggctgcacaatgggctgcctccaccttcttcacaaaatgctccatggcaattt

SEQ ID NO: 2766 - DNA, 77 bp, Homo sapiens
tttgggtgctcagcgactccacgaggcgggacagcactttctgctcctcacgcagagcggccacctcgcactgcagc

SEQ ID NO: 2767 - DNA, 27 bp, Homo sapiens
cttggtcagcatctatggaacccacca

SEQ ID NO: 2768 - DNA, 205 bp, Homo sapiens
ggaagtcgtcctgcatgaagcggggcgggaagcggttgaagttgtgggggtgcggaggctggttgaactgcgggtgctgctggtggggcgggaagggcccccggaagtgtgggggccgctgcatgcggaagggtggctcgcgctggcccccgccccagggcggctgctcgtgctggctgttccaggggccctcgaactggctgtt

SEQ ID NO: 2769 - DNA, 58 bp, Homo sapiens
ctgtttccaggagagcaaccaccacgtaggctgtcagcgggacagtgccgtggatccc

SEQ ID NO: 2770 - DNA, 59 bp, Homo sapiens
agagacccaaggatctgggtgctggaatggctgcggaggcgccgaagcagggggtgagc

SEQ ID NO: 2771 - DNA, 133 bp, Homo sapiens
cttggaagtgcctgtgagcttcccgctgttcctgcagcaccccttccgccggcacctctgcttctctgcagccaccagggaggcacagcatgcctggaggctggccctgcagggtggcatccggcttcagggc

SEQ ID NO: 2772 - DNA, 24 bp, Homo sapiens
gcaccatgaaacgccattcttcac

SEQ ID NO: 2773 - DNA, 370 bp, Homo sapiens
acagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagatgaggccggcaggcagagagcctcggggaaaccctcaaatgtgggccaccgcctgggccaccggcgggcgctcttcgagaagcggaagcgcctcagcgactatgccctcattttcggcatgtttggcatcgtcgtcatggtgacggagaccgagct

SEQ ID NO: 2774 - DNA, 32 bp, Homo sapiens
gccctcctcccacacgagagcccattttccag

SEQ ID NO: 2775 - DNA, 78 bp, Homo sapiens
tacgtagagacaccggaatcctagccctgacctcagccctgtggtcgccctcgcctccaccgccagtgtttattatta

SEQ ID NO: 2776 - DNA, 136 bp, Homo sapiens
attctgcaagacccctctgccatgccagggcacgcccattccagctggagtcgtggggctgggcacaggggaatttttccagagctgagcctgacgtctgctctgaagaatgcttagaaggttcccagacaccaga

SEQ ID NO: 2777 - DNA, 134 bp, Homo sapiens
gggatgcgccgagggagatgggaaacggggcggatggcgcccagcccagccctaactgccagctggctggggttgcgccccactgcgctgctgaccttcctgcagttccagacacctcccacaataaagagctc

SEQ ID NO: 2778 - DNA, 72 bp, Homo sapiens
gctctggccctgtccggacgcgccgagggcagccagggtgagcagaagaacgcaggcggtgtcggggaccat

SEQ ID NO: 2779 - DNA, 30 bp, Homo sapiens
cggagcgcagggcggtccagcccagcgcgc

SEQ ID NO: 2780 - DNA, 159 bp, Homo sapiens
tgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctcc

SEQ ID NO: 2781 - DNA, 30 bp, Homo sapiens
gaggggcgctgggcgcactggtcggggcgt

SEQ ID NO: 2782 - DNA, 147 bp, Homo sapiens
gccctcgctccagctgaacgcctccattgctgcttgttctggagacccccgcccccgcaccttccagacttagcagaagaacaaactgaagaacagacccagccagagaagcagggattccagaagctgcccattaagggagaagga

SEQ ID NO: 2783 - DNA, 171 bp, Homo sapiens
gccgcgaacgcagggtcatcactgcctcacaggtgctctgcttcaactgcatctggatggcgctgaacttgccgtgaatggcgccgaccatgcgctcaatctccttaggggagacaggcctcatcctgctctgctcctggaggaggttggtgacgtgcgtggtgaactcac

SEQ ID NO: 2784 - DNA, 42 bp, Homo sapiens
gcctttaatcggtcctcgcacctcaccacagataagataact

SEQ ID NO: 2785 - DNA, 72 bp, Homo sapiens
ccaaacgtaaacgaaagaacagcactggcagtggccactctgcccaggagctgccgaccatcaggacgcctg

SEQ ID NO: 2786 - DNA, 76 bp, Homo sapiens
ttttggagactggtggtcttaggctcttggctctggatcgacttctcatcctctctccgctttctcaggccagtat

SEQ ID NO: 2787 - DNA, 69 bp, Homo sapiens
ccgcacggctttcaggatctgctgattcaaagcagctctttgattctgcaatttactccggccggtttg

SEQ ID NO: 2788 - DNA, 24 bp, Homo sapiens
ccgcccgggagcggatgttcaatg

SEQ ID NO: 2789 - DNA, 162 bp, Homo sapiens
accacctccttcatgctcctctgtgatcacctctccaagtcccggtgtcaggagccttctctgtggccgccctggagagacttgagcctgggacgtgacgtgctgggctgtgaagctttctgagaagggaaacctgtggcctgacctgcctgaatgctgcac

SEQ ID NO: 2790 - DNA, 78 bp, Homo sapiens
gagaagctgcaccaaggcatcacagtctcagaccctccctttgacacccagccccggcccgatgacagcttttcctga

SEQ ID NO: 2791 - DNA, 73 bp, Homo sapiens
ccatccacgcccacatctctctgcctcctctcctgggctacagtgggccgctctgcctcgctcccgcccgcct

SEQ ID NO: 2792 - DNA, 242 bp, Homo sapiens
cactttttcctctgagcgcgggaggcgttactcactcttcctccttcccctcctcgccgactcccgggctctgggcccctgggggagggaagaggcctcctatctactcctctgccccagtcccctccttgcgtcagtcccagtgagggataagcgcctggcggaaggcgcagggaggtgtttctctgcttcaggagtgcccgccggcccttgcagctgctggaagacccatttatctcatg

SEQ ID NO: 2793 - DNA, 69 bp, Homo sapiens
cctgcgattacatccgggagttgcgccagaccaaccagcgcatgcaggagaccttcaaagaggccgagc

SEQ ID NO: 2794 - DNA, 77 bp, Homo sapiens
ggctcgttgaccaatctgtcacgctttgggttgcgtggacgcaggtgcatgatgtcactctcggccttttcatatgc

SEQ ID NO: 2795 - DNA, 57 bp, Homo sapiens
gagacccaggaacaggtccgcctgctcatcaagggaaactcggccagcaagacccgc

SEQ ID NO: 2796 - DNA, 78 bp, Homo sapiens
agtatgtgggctcgcgccccatcaagcttcgcaagagcatgtggaaggaccggaatctggacgtggtccgcaagaagc

SEQ ID NO: 2797 - DNA, 87 bp, Homo sapiens
gggacagggctaaaaagccagatccaggcctgaagaaacatcaggaggagccagagaaaccctcaaggaatcctgagagagaactgg

SEQ ID NO: 2798 - DNA, 298 bp, Homo sapiens
gtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagc

SEQ ID NO: 2799 - DNA, 25 bp, Homo sapiens
ggagaggtcctgccaggaacatctg

SEQ ID NO: 2800 - DNA, 58 bp, Homo sapiens
gttctgggaaatgggccgcagatgcatgaagttgcagaagccacctcgggtacattcc

SEQ ID NO: 2801 - DNA, 28 bp, Homo sapiens
ctgcagatcccgcatcccatctccactg

SEQ ID NO: 2802 - DNA, 72 bp, Homo sapiens
attccccaccagctctgatggcctctctcccttctcggagaccttcatccctgactccagcaagggccttgg

SEQ ID NO: 2803 - DNA, 65 bp, Homo sapiens
ccagcagcgagagcgcagggttcagtgaggtgtactccgcatccaccaggagccgcacgtgctgg

SEQ ID NO: 2804 - DNA, 86 bp, Homo sapiens
acctgcgtgcggagcagaaggaacagaggcacacgctgcgccactaccagcatgtggccgccgtggatcccgagaaggcacagcag

SEQ ID NO: 2805 - DNA, 190 bp, Homo sapiens
ccttgtcctcttccgccggagtcacctcccttctccgcccaaggacacgcgtagtcctcctctgtccaggaaccccaggccccacccgctgcgcgcagcgtgacagctggggacgcggcggggctggggctggggctggggctgggttgcggggagtcctgctcctcggattcgtccaccacggaggagg

SEQ ID NO: 2806 - DNA, 93 bp, Homo sapiens
tcggcgctttaggcgtctgtcacagacctatctgcgggtcgccttcacccagcatctcagaaactgcgcgcgggatgaacattcgggtgtttc

SEQ ID NO: 2807 - DNA, 110 bp, Homo sapiens
cactgggtctcaaccctttttctgtagggtgtctgaagcttggcagtcatctgtgaactcaagcagagctgctctgaagagatgggctggagtctagaggaaaatctggc

SEQ ID NO: 2808 - DNA, 25 bp, Homo sapiens
gggtgagacccgcccagctggcacc

SEQ ID NO: 2809 - DNA, 109 bp, Homo sapiens
agctgtcgcagaaggtaggctttcggaaggtgacctcatggaaggtgtgcaggaaggccaggcccaacttggagcagatggcgctggcccggagcaggtaccctgtcag

SEQ ID NO: 2810 - DNA, 98 bp, Homo sapiens
gtcttgcaagagtagggctcagctcctccccttgcccaggactccagcttctcagcccctagggagctggggcctcctcggtgcttgggaaggaaaga

SEQ ID NO: 2811 - DNA, 26 bp, Homo sapiens
agagacaggtgccatggtgtcctcca

SEQ ID NO: 2812 - DNA, 275 bp, Homo sapiens
ggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgccca

SEQ ID NO: 2813 - DNA, 142 bp, Homo sapiens
ctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggcca

SEQ ID NO: 2814 - DNA, 38 bp, Homo sapiens
gctgggagcagtaggatcatccactgggcgtgtctcca

SEQ ID NO: 2815 - DNA, 268 bp, Homo sapiens
ctctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttc

SEQ ID NO: 2816 - DNA, 36 bp, Homo sapiens
tgccagcctcagctcgtaggagttcatggttccaga

SEQ ID NO: 2817 - DNA, 71 bp, Homo sapiens
tgtgtgtgcccgtgatggaatacgcgtgtccctttaccaggccctcttctgtgcggtactcaccccgatca

SEQ ID NO: 2818 - DNA, 55 bp, Homo sapiens
ggaaggccgagaggcgatgggcaaagtcaaagaggtgctggccattggcgtaaac

SEQ ID NO: 2819 - DNA, 102 bp, Homo sapiens
gttgaaggtctcctggtatcgagtgatgatgtcacggaggtaccagctgatccgggccacatcatctcctttgggctgcaggatgtccgaagccatgtccat

SEQ ID NO: 2820 - DNA, 74 bp, Homo sapiens
aggcacggttgtcctgttttcctccaccacccagccgtccccaccgtgttgcaccatccactttcggaggcctt

SEQ ID NO: 2821 - DNA, 326 bp, Homo sapiens
gtttggagtcaacgtcaccatcccatcctggaagaagatgtggacctggcccacagcctccgttttgccatggcagatctggacttcggcaactacacggtaccaggggatggtattctgtagtcctgggcagcgggaagagagctcatagacaccaggagaggtggtggcaccacgggccccatcaaaggtggtgaggttggcacccacagacaggacacagagaccacgggtggcccagcagttccgggcttcagccttgacctcacatacacggcctggtgggcagccagctgcctggcatgtcaggccagagcttgaggaac

SEQ ID NO: 2822 - DNA, 31 bp, Homo sapiens
tagggatgtgtccatagacctctcccaagag

SEQ ID NO: 2823 - DNA, 170 bp, Homo sapiens
tggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctag

SEQ ID NO: 2824 - DNA, 104 bp, Homo sapiens
tcactggggcttgtgtggattaaaacctgaatctccaaccgcccaacagcccaggcctgggcgggaggtggagtcttccaaatgcgagtctgggcacaaaggtg

SEQ ID NO: 2825 - DNA, 65 bp, Homo sapiens
cctgcagaggagcccgccaatgagctgcccatgaatgagattgaggcgtggaaggctgcggaaaa

SEQ ID NO: 2826 - DNA, 50 bp, Homo sapiens
accagctccacctcggggatcttaagctgcacagcggtggactcagcctt

SEQ ID NO: 2827 - DNA, 27 bp, Homo sapiens
tgtacgccccagttagtggctggtctc

SEQ ID NO: 2828 - DNA, 44 bp, Homo sapiens
gcgggcgcagcgggaacagcgggcggcgcgcatgacctgtccag

SEQ ID NO: 2829 - DNA, 59 bp, Homo sapiens
cgaatgccggaaccggtccttctgcggtgcccacgccgtgtgccagaacctgcccggct

SEQ ID NO: 2830 - DNA, 24 bp, Homo sapiens
aggcccatcctggtaaaacttttg

SEQ ID NO: 2831 - DNA, 37 bp, Homo sapiens
ctcttctccaggccgaagacatgacggggagcaggcc

SEQ ID NO: 2832 - DNA, 44 bp, Homo sapiens
ccggggaaaaatcgtcatcatggacccagtctaccagggatatg

SEQ ID NO: 2833 - DNA, 76 bp, Homo sapiens
cagaagagttcaacccagaccgtttcctggatgcagatggacggttcaggaagcatgaggcgttcctgcccttctc

SEQ ID NO: 2834 - DNA, 46 bp, Homo sapiens
acagcgcccagagcccggatagagagacacggcctcactggctcag

SEQ ID NO: 2835 - DNA, 75 bp, Homo sapiens
tgccatctgcacgaggtcagagctggaggatttcctgagtgaagcggtctgcatgaaggaatttgaccatcccaa

SEQ ID NO: 2836 - DNA, 130 bp, Homo sapiens
gacagccctagtcttcgtgagcttcaacagcctctgctggagggcacagaatgtgagacccctgcccagaagcctggcaggcatgagctggggtcccccttaagagagatagcctttgccgagtccctga

SEQ ID NO: 2837 - DNA, 61 bp, Homo sapiens
agctcttggagtaacgcctctgcagcgattcccggtagaaacggaagacgtgttgcgaagc

SEQ ID NO: 2838 - DNA, 25 bp, Homo sapiens
ggctgtgtcccgaggctgctcctcc

SEQ ID NO: 2839 - DNA, 26 bp, Homo sapiens
atttcccctctaaacacatcttacag

SEQ ID NO: 2840 - DNA, 53 bp, Homo sapiens
cctgtcccaagcaaacctgggcagacccagccttgaccaagaataggagggga

SEQ ID NO: 2841 - DNA, 80 bp, Homo sapiens
ccggaccgagagaatcctcagtgacctcctgcccttctgcagaccaggccccgagggccagctcgctgccacggcccttc

SEQ ID NO: 2842 - DNA, 125 bp, Homo sapiens
tttagctcgatggtcctcctccttggggcaccggcccccctcccaccacttgcgcttcaggatctccagccggttgttctcctgaagctgcaggatggccagtgtgatctcatcccggaacgggg

SEQ ID NO: 2843 - DNA, 117 bp, Homo sapiens
gcgcctcccagtggtcggtactcacatgtagctgcggtgcttggtggcagcgtcctgttggtggctggggggtacagcggccggccccgtggggacttgatggcgtacaaggtgccc

SEQ ID NO: 2844 - DNA, 75 bp, Homo sapiens
tgctgtcccgggtccagtctggccgatacttggccccaagctctagggccttatctcgcagctcggagcggaagg

SEQ ID NO: 2845 - DNA, 75 bp, Homo sapiens
agctccttgcggtcccggtaccagcgcagggtggcagccggacgggaccgcggaacgaggcagctgagctccacc

SEQ ID NO: 2846 - DNA, 146 bp, Homo sapiens
tagtaccgtgagcgtggcaatctggtggtgggtgtcttctgtgtagagctggcagaaatagcccccctcgtcctccaggcgggcatctgagagccggatccgcacccggcgtggggagaactcctcaagctggaaacgctcatcct

SEQ ID NO: 2847 - DNA, 528 bp, Homo sapiens
gtgccagaaaattggaggcccgacagaagcccttcccacactcctcacattgatagggtttctctccagtgtggcacctctgatgggcttgaagctgtgaacctacactgaagcccttcccacactctgcacactgatatggtttctctccagtgtgaactctctgatgcacctgaaggctggagaactgactgaaggccttaccacacctctcgcatttatagggtttctctcctgtgtggattctacagtgtacattaagatctgagctccgactgaagcccttcccacatgtaccacatttgtagggtttctctccagtgtggcctctttgatgggccagaagatttgaggcctggctgaagcccttgccacactcctcacatttatagggtttttcccctgtatggactctaaaatgaatgttaaaatctgagctacgactgaagcccttaccacatgcatcacactgatacggtttctctccagtatggcctctttgatggtccagcagatttgaggcccggc

SEQ ID NO: 2848 - DNA, 196 bp, Homo sapiens
ttaaccaggcctcaagactctaccataaagagctctcagttctttgaacagggtgatgcccactcccaggttgaggaaggactatctataatgcacacaggacagaaaccttccaattgtgggaagtgtaaacaatccttcagtgatatgtccatctttgatcttcctcagcaaatacgctcagcagagaagtctc

SEQ ID NO: 2849 - DNA, 69 bp, Homo sapiens
gggccagggatctctgtccatcttgtgctcggctgtatccccagtgccttcagtgacgcccagcacatg

SEQ ID NO: 2850 - DNA, 82 bp, Homo sapiens
gcgcagcctgcagcgggagaccctgtccccgccccagccgtcctcctggggtggaccctagtttaataaagattcaccaagt

SEQ ID NO: 2851 - DNA, 44 bp, Homo sapiens
gcgctgttggcccggtgggcagcgtggggggtatcgcgggtagg

SEQ ID NO: 2852 - DNA, 84 bp, Homo sapiens
acgacgggccggaggtggacatctggagcctgggagtcatcctgtacaccctcgtcagcggctccctgcccttcgacgggcaca

SEQ ID NO: 2853 - DNA, 174 bp, Homo sapiens
agagaccaatgtttcccacccagaccccaagactgctgggagagatggtgtcagcagtgactcccaggaatatccagtggtgtggtggcccatcccaggcccggctgggcaggtggctggcttgctgggggatgtgatgatggtggtaggcatgggaggcactttggacgggat

SEQ ID NO: 2854 - DNA, 36 bp, Homo sapiens
aggaggcgcgggagagtctgaccacagcgactccag

SEQ ID NO: 2855 - DNA, 422 bp, Homo sapiens
gggcgaactgacgatgacttaggtagtaaagggacaggccggtccctagcaaaggcaactgaagaggacagcgagggaggaccggataaaaggacagtagcagtaggtccaggactggggactggtgaccaagtgactgagcctgaaagccagaatggactagccctggtcaagaccggtttttcctcccaaaaggccacgtcctgctggaacagaccacagaatgccgggctgggaggcgtttccctggaagacccagcatagccatgccagtggggtgcgccataggtggaagaagaggggggttatgttggatcgatccactcagggaggggaggatgtcaatgacaggtactaagatggattaaggtcaggagccgcagggtggtgactcattggagctaacgcagtccaggattcac

SEQ ID NO: 2856 - DNA, 25 bp, Homo sapiens
cagaccacccgccactgtagcacac

SEQ ID NO: 2857 - DNA, 136 bp, Homo sapiens
attgatcggaagcctccccgaagcccggctgcggagggtggtgggacaactggatccacagcgtctctggagcacttatctgcgccccctgctggttgtgcgaaccccgggcagcccgggaaatctccaagtcaga

SEQ ID NO: 2858 - DNA, 94 bp, Homo sapiens
aggacctgggagacgagcatgctggtggggaaggtggcggtgaggatgatcttgccctgctgcagggccacacccgtcacgatggggctgccag

SEQ ID NO: 2859 - DNA, 125 bp, Homo sapiens
cccggctataaagcgtggccgcctcccgcggcgctcgggacagccgtaccccgggcggtcggacgggcgggcgccggtgggagctcgggccgtgcccgctgagagatccagagcgctccgttccc

SEQ ID NO: 2860 - DNA, 95 bp, Homo sapiens
cgacacacggcctcgctgaagtcccacaccatggcccacggcatcttgggcaggtcgcacaggtagcaccactggcggcgggacgcctgcacaga

SEQ ID NO: 2861 - DNA, 31 bp, Homo sapiens
ccaccacgcccgacagtaaatatgttttgaa

SEQ ID NO: 2862 - DNA, 329 bp, Homo sapiens
ctggaggtctcgaagtcgctgaactcgctgtcgctggcgttgctgctgtcgtacgtgcccacgaccagccggggcggaggagtcaccatctgctgcactctcctcctcactcggggctccttgggctttttggggggctggggcgggtgcggggtgctcttctccatgatgcgggccacgtcctccagggtgcggccctcttcttccaggaactgggtcagccgctcccgaaattctgcttccttggtggcgggcttagagatgactctccagacgcccccagccagcctgacctcccgggggatgagcaaatagtcgacgtcctcccc

SEQ ID NO: 2863 - DNA, 25 bp, Homo sapiens
cagtagcggtggcggcgactgcagc

SEQ ID NO: 2864 - DNA, 86 bp, Homo sapiens
cctccatgtcatacaagacggtgtcgccagagcggaaggaggccacgatgtgggcaggctcggtgctggtgaaggccactgaggtg

SEQ ID NO: 2865 - DNA, 445 bp, Homo sapiens
cattccggtatctacagcagcgcatatacagtatcttacaggctgggccatccctccccactcccagactcctccctcttccgagatttccccccctccctgactccccgtcttccccccagcgcttggccctggggactaaggctggggcggcttcagccaaaatctcccaccccccaaatgaatgccagtggtcacacgtgctctctctaaacctatgcaatgggattgatggggcggggggcggtcacgggcagagcacaggattcacagtctgggcccctcctggccaccccctgatgaaggtgaggcaggcatgcccaccacccgccggctggctcagggaagatggctgggcgccgggctggagcaaccggcaaacgagccccactctctggctccaggaggctagtggtcacgtttggctcatttgctcttcacgggc

SEQ ID NO: 2866 - DNA, 42 bp, Homo sapiens
tgcggtcgcagaggccgacggagccggagtcgcggacgccgc

SEQ ID NO: 2867 - DNA, 27 bp, Homo sapiens
ctgcccatgaaccatcccaccgctatg

SEQ ID NO: 2868 - DNA, 37 bp, Homo sapiens
tgccgtgctgctcgccgtgtactacggtctcatctgg

SEQ ID NO: 2869 - DNA, 31 bp, Homo sapiens
catggttgctcactcccgtaataaaaaaata

SEQ ID NO: 2870 - DNA, 28 bp, Homo sapiens
gccccatcagaggggacgtgctgggtgt

SEQ ID NO: 2871 - DNA, 312 bp, Homo sapiens
agagagagaaaccggcctcatgactcagctggtcaggagatagggggccagatgctgaccccaaatccccggcagcacccctagcaaataggtctgtatcaaagattctgtacagctggttttgggggtgaagggcacctatgggggcttaaataaatggacagggggcaagggatgtagcgagaacagagggtgactgtccggccagcagcctgggcctctggcgcccctgcatgctgacccccggtgccacctgcccactgtggcccgcggcactccccagatgggaaaggagggaagctctccagcaag

SEQ ID NO: 2872 - DNA, 26 bp, Homo sapiens
cccagccgcctgagggaccgctgccc

SEQ ID NO: 2873 - DNA, 29 bp, Homo sapiens
ttcctgaatggtccgtttcgggagctgct

SEQ ID NO: 2874 - DNA, 24 bp, Homo sapiens
tgggcatgtaggaaggcctgcact

SEQ ID NO: 2875 - DNA, 78 bp, Homo sapiens
cttggtggagaatgaactgctgcagaacacacccgaggagatcgcccgcttcctgtacaagggcgaggggctgaacaa

SEQ ID NO: 2876 - DNA, 85 bp, Homo sapiens
ttctatggagctttcgcctacccggagaggcccagaaaattgaccggatgatggaggccttcgcccagcgatactgcctgtgcaa

SEQ ID NO: 2877 - DNA, 81 bp, Homo sapiens
gaagaaccacttcacggtggcccagagcgaagccttcgatcgtgcctaccgcaagcagatgcgggggatgccgaccttccc

SEQ ID NO: 2878 - DNA, 94 bp, Homo sapiens
tggggccgccacctacgaagagaaccgtgccgaggcccagcgctgggccactgccctcacctgtctgctccgaggactgccactgcccggggat

SEQ ID NO: 2879 - DNA, 328 bp, Homo sapiens
ctccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagc

SEQ ID NO: 2880 - DNA, 35 bp, Homo sapiens
tagccagggcttgggagaggctgagaacccgctcc

SEQ ID NO: 2881 - DNA, 76 bp, Homo sapiens
gaagccagcctcggatgtgcacgggaaggttgggatccctcctgagcgcattgcctctcttcccaaaggcgtggat

SEQ ID NO: 2882 - DNA, 78 bp, Homo sapiens
atccggggcaccagctaccagagccctcacggcatccccatagacctgctggaccggctgcttatcgtctccaccacc

SEQ ID NO: 2883 - DNA, 25 bp, Homo sapiens
tgccccaagcaccatatggaaataa

SEQ ID NO: 2884 - DNA, 87 bp, Homo sapiens
gggcactgtctggatcaacgcccacggcctcagagacccttcggtgcccacaggcggctgcaaggagagtgggtgttcctggcacgg

SEQ ID NO: 2885 - DNA, 39 bp, Homo sapiens
gcggctgagcaaagcggaaatcctgggtaattggaacat

SEQ ID NO: 2886 - DNA, 74 bp, Homo sapiens
agaagatgagtctcgagggaagacagaggagtcgggggaggatcggggcgatggtccgccagacagagacccca

SEQ ID NO: 2887 - DNA, 96 bp, Homo sapiens
ggcttgtcgggaaggcaaggtctcggtggaggtggtgaccgctggtggagccgccctcccgccgcccctgctgccgcccggcgactcggagatcga

SEQ ID NO: 2888 - DNA, 32 bp, Homo sapiens
acttcctgtatgtcacacccacgcctctgcag

SEQ ID NO: 2889 - DNA, 36 bp, Homo sapiens
tcctacaaagcatcgtgtgagatccgcgtgcttatg

SEQ ID NO: 2890 - DNA, 65 bp, Homo sapiens
gtgttgtcgatggcgacccgtttcccttgcttcagggctgtctcacacgtggtcacacagcgctg

SEQ ID NO: 2891 - DNA, 96 bp, Homo sapiens
tcatctgatgaccgcgcctctgtcctcttctccttgaagccccagacgggcacagacacaggcagggacttggcgtactgctgtgtgggtagggct

SEQ ID NO: 2892 - DNA, 105 bp, Homo sapiens
gggcctacctggttctggtgacccaggctggaggttccctgcccgcactgcacttccaccgcgggggcacccgcgccctgctccgcgtcctcagccgctacctgc

SEQ ID NO: 2893 - DNA, 94 bp, Homo sapiens
gaaggcagctgtacttcgggcagtggaggaacgtgagcgggccgaggcagagggccgggagcgtgaggctcgggccctgtcactgacacgggca

SEQ ID NO: 2894 - DNA, 76 bp, Homo sapiens
ctccgcgccttcggggtcaccgatgaggggttctctgtctgctgccacatccacggcttcgctccctacttctaca

SEQ ID NO: 2895 - DNA, 57 bp, Homo sapiens
atcaggacccccaccggggacgagtttgtgaagacctcagtgcggaaggggctgctg

SEQ ID NO: 2896 - DNA, 120 bp, Homo sapiens
tgccagtgctccacgggcttgcggggattggccagcatctctgcccagtgctcgcggccgtgcgggtcggcagcgtcggggcccacacggcacacgccgatcacctcgttgtgcccgatg

SEQ ID NO: 2897 - DNA, 84 bp, Homo sapiens
ggcgggggaatgtcctccgaaccaggcacagacaggctgcggctgaatttcatggctgggggtgctaggtaaggtctgtcatct

SEQ ID NO: 2898 - DNA, 69 bp, Homo sapiens
gatttttgccggagcatcaacccaggtcctggaggcaggaaagaaggacgctcgtaacttggctgggca

SEQ ID NO: 2899 - DNA, 25 bp, Homo sapiens
tgtaaactcgggtcttgtatcggaa

SEQ ID NO: 2900 - DNA, 87 bp, Homo sapiens
gtgctgaaatggtacagagccgcctgccagggctgggaatgctgctcacactcccagcctcccacaatccgggactgaatcgggggc

SEQ ID NO: 2901 - DNA, 180 bp, Homo sapiens
cagcggttgcacagtcattgggcaggggcaggggttgaacgctgctggttacgcggacgggcaggcgcagccgcagcagccggaggtcgtgctcgtggctcgtcgaggctcccaggtagccgggatgggtcacagagaagccgctgtgccggatctgctcggtccagtcgagctggctga

SEQ ID NO: 2902 - DNA, 39 bp, Homo sapiens
gggcaggaatgacacccaccctaccacagggtcagcctc

SEQ ID NO: 2903 - DNA, 227 bp, Homo sapiens
atcgaccgtgggtatcctcttgcacttttccacttggggtgtttgtggccactggaatatcccatggtatatcggccccttccttgaaccaggatccataaacagggctagaggcagtccagttgtaatgggggtaaaggacactgcagggcacagagacacacagaccctcctgcacagtcaccgactctggcacctccagcctgtatcttgacagtaggtcctgg

SEQ ID NO: 2904 - DNA, 24 bp, Homo sapiens
gagtagtacagagcgacatgatca

SEQ ID NO: 2905 - DNA, 221 bp, Homo sapiens
acactactgctaacatggccaagcacatggatgctccagcattttctcagcttcctgctttgttttcttgatctgtccccatgttatgggggtggatgtcagtgtgactccagtcggcccttgctccatctttgcattcaaattcagctggctcacgactcctactggagggaccaggtccacggttggccaacgtgggtcctgctagtctcccatttcat

SEQ ID NO: 2906 - DNA, 29 bp, Homo sapiens
tgaacgtgcaccggcgctgtgtgcgtagc

SEQ ID NO: 2907 - DNA, 28 bp, Homo sapiens
gcgcgccgtgccaggaagactttattct

SEQ ID NO: 2908 - DNA, 28 bp, Homo sapiens
taaggtggtctacacctccctgcaatgg

SEQ ID NO: 2909 - DNA, 75 bp, Homo sapiens
caaggtccaggagagcttgtggtctccttcctcagtcagaatgaacctgtcgaatctcagccgtgagccacactg

SEQ ID NO: 2910 - DNA, 24 bp, Homo sapiens
aatccaagcgctttgtgcagtggc

SEQ ID NO: 2911 - DNA, 152 bp, Homo sapiens
tagaggccgatgacgtcgttcagctcgaggtccgcgttggggcggcagcgggcctgggggggctgcgtcccggggcggggttccgcgtcgggcttggcggcagccgcctccgggcgcgccgcgtccatgacgcccagcaccgcgtccagcat

SEQ ID NO: 2912 - DNA, 25 bp, Homo sapiens
ctcacccacaaggtccgtctcaaca

SEQ ID NO: 2913 - DNA, 125 bp, Homo sapiens
ggttcatcctggacccgaagtgatctcgggagagaaggtgaccttctactgccgtctagacactgcaacaagcatgttcttactgctcaaggagggaagatccagccacgtacagcgcggatacg

SEQ ID NO: 2914 - DNA, 37 bp, Homo sapiens
ataacccgcggctgtgaacatcctgtcggcctccatc

SEQ ID NO: 2915 - DNA, 84 bp, Homo sapiens
aggtggagccatggatgcccgtgtgtctgcccagctctgtcctggccacgccggggtgcagggcgttgacagtcacaccagagc

SEQ ID NO: 2916 - DNA, 86 bp, Homo sapiens
gtcaggccctcaagggctgggttgctggcttcaagaggctgggccaggatgtcaaggggcggagttccgggttccacagctgggac

SEQ ID NO: 2917 - DNA, 116 bp, Homo sapiens
tcaacggccgactctctctcatcttccttacaaagctgaagggcccaaggagaccctcggactgcagctgccggagcaggacgtccagggcaatgagggttcctgtgcgacccacg

SEQ ID NO: 2918 - DNA, 81 bp, Homo sapiens
cccagccgtcggttcaagcgagtggtggagaccatccaggcacagctcctgagcactcatgaccagccctccgtgcaggcc

SEQ ID NO: 2919 - DNA, 42 bp, Homo sapiens
cagcatcatgtactcaacccgcaagcggagtgctcagctgtg

SEQ ID NO: 2920 - DNA, 34 bp, Homo sapiens
aagcgcgggtcgaagggcggcgtcgaccatttcc

SEQ ID NO: 2921 - DNA, 33 bp, Homo sapiens
ggtcccagagtgggtggtcatctctggtgatga

SEQ ID NO: 2922 - DNA, 44 bp, Homo sapiens
aaacctttgaccagaggcgctaaagaggagcacggtggactgat

SEQ ID NO: 2923 - DNA, 24 bp, Homo sapiens
atggagaatgaggcgatagcttct

SEQ ID NO: 2924 - DNA, 950 bp, Homo sapiens
ctggagctgtagggaaagaacttcccacattcactgcactcataaggcctctccccagtgtgaactccccgatgttgaaggagtgcagacctttggctaaaggatttcccacattcgctgcacttataaggcctttctccagtgtgaaccctatggtgttcaatgaggctagagttttggctaaatgacttcccacattcgctgcactcataaggcctggatccactgtgaactttctggtgttttatgagactggaatgatatgtaaaaaacttcccacattcactgcactcataaggcctctccccagtgtgaactccccgatgttgaaggagtgcagacctttggctaaaggatttcccacattcactgcactcatatggcctttccccagtgtgaactctccgatgtttaatgaggttagacttgttgctaaataattttccacattcatcacattcatgaggtcgtactgcagtgtgaactctccggtgctgaatgagactagagctttgcctaaaggacttcccacactctcgacattcataaggcttttctccagtgtgaagtctccaatggtcattgagactgtagcttttgctaaaggatttcccacattcactgcatatgtaacatctttctgtagtgagggttctctgctgctgaacaagtgtgtgtttaccgctgaatgcttttgtgtgttctccacagttgtaatgagtttttcctctgtgactgatggccccaccgtcgcttttgctatttgattgctccccagtgtgagcagcctgttgatggagaaatcccaacttggccaggaagtccttcccaacttctctgcaggtggaaggctcccctgacacatggaatgtgcaggtcttcacaaacaaggctctgcccacattgcttctgaaatgtttttctccaaggtgctgcttctgatgatgaac

SEQ ID NO: 2925 - DNA, 33 bp, Homo sapiens
ttcccgcgggacaagcccggctcgtcagcccca

SEQ ID NO: 2926 - DNA, 37 bp, Homo sapiens
accccggaagagtggggactgctggacctcaaacaga

SEQ ID NO: 2927 - DNA, 27 bp, Homo sapiens
acagaggaccgagtaccgcgatgtgat

SEQ ID NO: 2928 - DNA, 85 bp, Homo sapiens
tcacgcaaggaagagggcctgcctgaagaggagccatcccatgtcacgggaagggaaggattcccgacagatgctccttatccca

SEQ ID NO: 2929 - DNA, 59 bp, Homo sapiens
acttgcagcacagtcccctgaggggaaccatggacaccaagaaccagcctccacatcct

SEQ ID NO: 2930 - DNA, 101 bp, Homo sapiens
ggcttcgactggaagtcagtgttcgtcatccaccaccggacacacacgagtgggccaggtgtgcagtccccggggctagccaccggggaaagcacagagaa

SEQ ID NO: 2931 - DNA, 260 bp, Homo sapiens
aatcagaaattcccacctggcccagcagcaccaaccagaaagaagggaagaagagaggaaaaaaccacaggaagaaagaaaggagggagggagggagaggaggaaggaaggaggagggaagggaaggggggaagaagggagggagggagggagggaaagaaagagggaggaagggcagagggagcagggagactgtagatcagggtctgaatggagatccggtcctggaagtaaatgatccaaggctccaggtgctggga

SEQ ID NO: 2932 - DNA, 59 bp, Homo sapiens
acatggcctaagatgtgggtcctggatccttccccccttctcaccataaccccctctca

SEQ ID NO: 2933 - DNA, 93 bp, Homo sapiens
accacgacaatcttatcgcctgatgccttcttcaccacctgatgggctttgtgcgagctccacccagcacagtcacgcccgtcaatctgcagg

SEQ ID NO: 2934 - DNA, 38 bp, Homo sapiens
cttggtccacttttaggtcctctagagatgggtacagg

SEQ ID NO: 2935 - DNA, 172 bp, Homo sapiens
cagcaacaacgaccgaggtgtggtgcaaggacagtggcagggcaagtacggcggcggcaccagcccgctgcactggcgcggcagcgtggccattctgcagaagtggctcaagggcaggtacaagccagtcaagtacggccagtgctgggtcttcgccggagtcctgtgcaca

SEQ ID NO: 2936 - DNA, 26 bp, Homo sapiens
tagggccttggtgggcgcattcccgg

SEQ ID NO: 2937 - DNA, 24 bp, Homo sapiens
ccttcatggaactcagcacctgct

SEQ ID NO: 2938 - DNA, 108 bp, Homo sapiens
agcctcgcttgctgtctgctcggcctcctggcgctgacctccgcctgctacatccagaactgccccctgggaggcaagagggccgcgccggacctcgacgtgcgcaag

SEQ ID NO: 2939 - DNA, 45 bp, Homo sapiens
cggccaacgagctgcgggcccgggatcgcggcggctggacggggc

SEQ ID NO: 2940 - DNA, 83 bp, Homo sapiens
aaatatcggtctcccgtaggttgctgtagtcggccaattcgtaggcctggcaggtggcgccctcggccacctcgtgtgggacg

SEQ ID NO: 2941 - DNA, 44 bp, Homo sapiens
tgaatgaagcttttaagtaccggcatctcgaactttatatactg

SEQ ID NO: 2942 - DNA, 90 bp, Homo sapiens
gaatgcgttcgttgtcatcctgcatctgcaggcgaatgggccggcgcaggccccaggagatgttcaggagcccctccacaatgaactcgt

SEQ ID NO: 2943 - DNA, 25 bp, Homo sapiens
gaggttccgcaactgtgtcatttgg

SEQ ID NO: 2944 - DNA, 49 bp, Homo sapiens
tgggagctgggatacacagggaaaggtgttaccattggaattatggatg

SEQ ID NO: 2945 - DNA, 88 bp, Homo sapiens
ctgaggcattcttgggccacatagcagttgactgccctctccaccatcttttcacaagtgttaatcccaataaacacccatcctcttc

SEQ ID NO: 2946 - DNA, 29 bp, Homo sapiens
ccagtaaagtggcggtgctctctcttcct

SEQ ID NO: 2947 - DNA, 24 bp, Homo sapiens
catcatgatccagcccattctcta

SEQ ID NO: 2948 - DNA, 32 bp, Homo sapiens
tgttcggcgtccacctgaacaagtggcagctg

SEQ ID NO: 2949 - DNA, 39 bp, Homo sapiens
agcagagggcggtgcaaagaccttgagcggcggccggcc

SEQ ID NO: 2950 - DNA, 86 bp, Homo sapiens
cctccttgcggcagcgcgtggagtgcggcgtcctggagctgcggatgaggtgggtaacgccgtgctgactagcagcgacgcaagga

SEQ ID NO: 2951 - DNA, 197 bp, Homo sapiens
actgaaggccctcggtgctggccagccagcgcgtgtacgggttgtcgctgctgtcgtagaaggggttcttcaggggcaggctctgcaccgcgtccagggcgccctgccccagcggcccggccctcttggctggctcgggcccctcgttctcttcctccggaccttcggccacagagccctcctcatcgttggtgtcc

SEQ ID NO: 2952 - DNA, 117 bp, Homo sapiens
tgccggtggctctccctgatcctcctcaccattcccctggccctggtggccaggaaagacccaaaaaagaatgagacaggggtgctgaggaaattaaaacccgtcaatgcctcaaat

SEQ ID NO: 2953 - DNA, 126 bp, Homo sapiens
cctgcgcaggatgtctgtgatcgaggagggggactgcaagcggatcaacatggcccacctgtgtgtgattgggtcccatgctgtcaatggtgtggcgaggatccactcggagatcgtgaaacagtc

SEQ ID NO: 2954 - DNA, 43 bp, Homo sapiens
ggcaccaccgggtcgtcctcagcgtgcaggatgagcaggggac

SEQ ID NO: 2955 - DNA, 24 bp, Homo sapiens
tatatgaggtcactgggaggagat

SEQ ID NO: 2956 - DNA, 110 bp, Homo sapiens
ggtaatgagaccaagccttgctcggtttaacccgagtggaagactctagaagtagcgcgggctcatgactgaagaggccaagctggaattcctcaagactcactttgccg

SEQ ID NO: 2957 - DNA, 29 bp, Homo sapiens
tggagtcggatcccgaacgcaccctcgcc

SEQ ID NO: 2958 - DNA, 26 bp, Homo sapiens
agctagctggccctcgccgccggcgc

SEQ ID NO: 2959 - DNA, 25 bp, Homo sapiens
ggaaatggtggtggagccgccgctg

SEQ ID NO: 2960 - DNA, 30 bp, Homo sapiens
ggcgccctcctccttgttcgcgtcctcggc

SEQ ID NO: 2961 - DNA, 31 bp, Homo sapiens
cttcttcaccagtgacacggggcttgaatat

SEQ ID NO: 2962 - DNA, 24 bp, Homo sapiens
gaagcttcaggggaccacgtctgt

SEQ ID NO: 2963 - DNA, 24 bp, Homo sapiens
atgctccccaagatggtcaacaag

SEQ ID NO: 2964 - DNA, 31 bp, Homo sapiens
tgctgaatgtctccggcctctttgttctcct

SEQ ID NO: 2965 - DNA, 24 bp, Homo sapiens
cgggcgcgagctgggggtgccgcg

SEQ ID NO: 2966 - DNA, 37 bp, Homo sapiens
tgatgcggcgcccattcttcaaccgataccggtccac

SEQ ID NO: 2967 - DNA, 114 bp, Homo sapiens
caaacagtcagaatcactcagtgaactgatcactcttcgggaagccctggagtcaagtcacctggaaggggagttactgaggcaagagcaaacggaagtgaccgcagcgctggc

SEQ ID NO: 2968 - DNA, 87 bp, Homo sapiens
ggcgagaaatgctttgcaggtcgacctggcggaggcagagaagaggagggaagccctgtgggaaaagaacactcacctggaggctca

SEQ ID NO: 2969 - DNA, 59 bp, Homo sapiens
ggagggagttcatagcaaccactccctccatcaccacggagaccatatcgaccaccatg

SEQ ID NO: 2970 - DNA, 73 bp, Homo sapiens
ctgcttgtgccagggactattctcaggctgaagaaggtgggaggggagggcggaacctgaggagccacctgag

SEQ ID NO: 2971 - DNA, 88 bp, Homo sapiens
gcctagtggcgtataagaagaccccgccaccggtccctccacgcaccacttcaaagccgttcatctcagtcacagtccagagcagtac

SEQ ID NO: 2972 - DNA, 48 bp, Homo sapiens
ggcccagttccacgcacccagcgagcccaagcgccttctccgcaccag

SEQ ID NO: 2973 - DNA, 101 bp, Homo sapiens
gcggtgagatgtacagccagccattgtcaaggcagtggatcctgtagtgtctgatccggtcccaggatgcagggcggctgaggcggactgacagagagtaa

SEQ ID NO: 2974 - DNA, 82 bp, Homo sapiens
atgggagactttggccacgtggacgctggggatgttatactctctgcctgagacttcagacagcaccgtccaccagtctcca

SEQ ID NO: 2975 - DNA, 80 bp, Homo sapiens
ggtcgggcttagagtccaagtcaccagtgcggaaagcctctcggatcctgggctcccattccggcaggtccctgaagtca

SEQ ID NO: 2976 - DNA, 151 bp, Homo sapiens
tcctggcgagtccttcctgttcagctccctgtgcgaccctccagggatgcaggggatccaggattctctgccctgtcacacggcgagtcagaagggaggggcctttccctcggacccatggccccaggcagagttttgcaccagcaggacc

SEQ ID NO: 2977 - DNA, 93 bp, Homo sapiens
ggccaatgatgacattccggaagcccttcacagccttcagcttgtcgctctcgaagttcaccaccagcttgtggaggcccatgtggagcggca

SEQ ID NO: 2978 - DNA, 86 bp, Homo sapiens
agaacagtgtgtggaactcgcagctggatgcagtatgcccggacaccatgaacaaccctctttcccactactggatctcctcctcg

SEQ ID NO: 2979 - DNA, 39 bp, Homo sapiens
ccaagaaggactcgggtcaatggagacaaccgcctctag

SEQ ID NO: 2980 - DNA, 26 bp, Homo sapiens
gcagggaaggtgcctagagtccccac

SEQ ID NO: 2981 - DNA, 24 bp, Homo sapiens
cggggtcacctgggcgctgcccat

SEQ ID NO: 2982 - DNA, 184 bp, Homo sapiens
tcgtgtgaggagcactcggatctcatactcaacatcggggtccagatgccacagcttatagttgggagagtcgactatgtgggtctctgcccacgtgcctgtggtggtgcgatattccacttccttcaggatgatggggccatccccgatgatggagttggcatttggcttgatccacaggtat

SEQ ID NO: 2983 - DNA, 45 bp, Homo sapiens
tgcaggggttgcttacctcgggtaggaaaccctcaggcggtggca

SEQ ID NO: 2984 - DNA, 65 bp, Homo sapiens
gggggagccctgcgaccaactccacgtctgcgacgccagccagggcctggtctgccagcccgggg

SEQ ID NO: 2985 - DNA, 90 bp, Homo sapiens
aggccccatctggtcctaagtccctgctgcccttccccttcccacactgtccattcttcctcccattcaggatgcccacggctggagctg

SEQ ID NO: 2986 - DNA, 98 bp, Homo sapiens
ccgtgtagtttcagattcttggtccatggatgacaccacctgcccatgcttccttgaattaggctttcctaacctgaagcgccttcaaacttccaata

SEQ ID NO: 2987 - DNA, 88 bp, Homo sapiens
gtggggaggtacagctgggagtgtgggggatggggaaggatggggagggaacgggcccgtggacaacttgcatttgccctgacaccca

SEQ ID NO: 2988 - DNA, 121 bp, Homo sapiens
accctttggggctgaatgcgaccccactgccccaagactcaagcttggtggaaactcccccggctgagaacaagcccagaaagcggcagctctcggaagagcagccaagcggcaatggtgt

SEQ ID NO: 2989 - DNA, 25 bp, Homo sapiens
agctgcttgcgtgtcggcaccgtac

SEQ ID NO: 2990 - DNA, 79 bp, Homo sapiens
ggacagctccagagtcggggaagcgccatggttcctgcgcagaaaggatgcgggttggggccggcagatcctgccagga

SEQ ID NO: 2991 - DNA, 26 bp, Homo sapiens
tggagggatattcccgagaggcagag

SEQ ID NO: 2992 - DNA, 74 bp, Homo sapiens
tggtcaccaccactcaactaattcctgccctggccaaagtcctgctatatggcctggggtctgtgtttcctatt

SEQ ID NO: 2993 - DNA, 24 bp, Homo sapiens
accatttattgatgacaaacactt

SEQ ID NO: 2994 - DNA, 106 bp, Homo sapiens
gctcgggtgtcaggttgacagttatgtttttatacaaggcgtcgtatgtgatgtttgcaaagtagttcaggttgttgaggccatccagcccttgccgttcttttga

SEQ ID NO: 2995 - DNA, 68 bp, Homo sapiens
cgcagccagctcgcgggccccggcgtgctgcgcgccccagcggcaacaagacgcctcgtcctcgtcca

SEQ ID NO: 2996 - DNA, 121 bp, Homo sapiens
atggcgaatgtgccttgcagattacatatgagtatatctgtctttgggacgtccagaatcccagagtcaaactcatctcttggccgctaagcgccctgcggcggtatggacgtgatactac

SEQ ID NO: 2997 - DNA, 92 bp, Homo sapiens
aacaaagagcgtttgcagttgcacgtgcaggagacattgggctgcccggcggcggcggcggcggtgctgttgacccccatcaagcggtgcat

SEQ ID NO: 2998 - DNA, 142 bp, Homo sapiens
agaccagagcgaattcatcctgaagaactcagagaaagccggtgcaggaagtgggttcccgctctccctgcacaggcacagtgatgctgccagagctctcccagaaagaccaggaggcttgttctggagaagtcaagcccag

SEQ ID NO: 2999 - DNA, 148 bp, Homo sapiens
ctatccggtggaggaggaccatctgcctctcgctcagtgtgtggttcaggcggtgtgcaatggagatgggggtctcccccttggcatctctgtcgtggatggaggccccgtgctggagcaggaggattatacagtctgaccggcccat

SEQ ID NO: 3000 - DNA, 24 bp, Homo sapiens
tacaataaagcaatcacgcagatt

SEQ ID NO: 3001 - DNA, 68 bp, Homo sapiens
gcttagcgaatgccacagacggcgtgcggctagcagcccgcatcgtggacacaccctgcaatgagatg

SEQ ID NO: 3002 - DNA, 26 bp, Homo sapiens
tgccggggatgaagcgagactgcggg

SEQ ID NO: 3003 - DNA, 92 bp, Homo sapiens
cagaacattccagaacccgttgtggaaaaaccctttcaagaagctgttttaagaggctcgggcagcgtcttgaaaatgggcaccgctgggag

SEQ ID NO: 3004 - DNA, 73 bp, Homo sapiens
tggaacaggagttgcaacctgatttgctggactctttgggttcaaaagcgactccgtttgaggaaatatattc

SEQ ID NO: 3005 - DNA, 125 bp, Homo sapiens
gtacacagtcatcgttcaggccacagatatggaaggaaatctcaactatggcctctcaaacacagccacagccatcatcacggtgacagatgtgaatgacaacccgccagaatttaccgccagca

SEQ ID NO: 3006 - DNA, 39 bp, Homo sapiens
gcgcagccggagtatccacctcgatgaccacgggctgag

SEQ ID NO: 3007 - DNA, 95 bp, Homo sapiens
tgtggcgtccactgcccggttcaaagcctctcgcaggtccatgaggccggcctcgtgctgggccagccggtcgcgggtttgtgtggccagtgcct

SEQ ID NO: 3008 - DNA, 37 bp, Homo sapiens
ggccgcctagccgccgtgcgtcctgcccgaggcttgt

SEQ ID NO: 3009 - DNA, 124 bp, Homo sapiens
gccacacgcggccggcgttgatgaggacttccacggggaaggtggggtgggctggctggtagccgtgcagcaggaaggcatagcggcccagcgtgggcacatgggtggtgaagaccacggtggc

SEQ ID NO: 3010 - DNA, 111 bp, Homo sapiens
gaagtgaaagtagccgggggcacagcgatcacatgtggccccctcgaagcccactcggcacctgcactggcctgtgtcagggtcacagcggtcatcggccactccagggct

SEQ ID NO: 3011 - DNA, 52 bp, Homo sapiens
tgcagccacccccagacgaggcccgcagggacatggccggggacacccagtg

SEQ ID NO: 3012 - DNA, 72 bp, Homo sapiens
cgccgcctccacggagctgcacaacctggcctcccgcacagagtacctggtctccgtgttccccatctatga

SEQ ID NO: 3013 - DNA, 88 bp, Homo sapiens
gctgactttgaggcccggggtcaggtcctcggtcacaaactcgcaggggcagctcttgtcatccacaatgtcctctccggggaggctt

SEQ ID NO: 3014 - DNA, 25 bp, Homo sapiens
tagagcgtccggggcagcatccaca

SEQ ID NO: 3015 - DNA, 151 bp, Homo sapiens
cgtgcagcagcttccgtagcgcagccgggggcaggttctcgtacagccgggcctgctgcagggactcgggcctggcgacagtgtccagcagcccgtcctccccgacggtcaccatcaccttctggctctcgtccagaagctcccgtaggat

SEQ ID NO: 3016 - DNA, 91 bp, Homo sapiens
ccgttcatgcggatggctctcttccagtccttcagggtggacttcccggccaggtgcacaaattcctttgggctgattacatgctcgtcgt

SEQ ID NO: 3017 - DNA, 85 bp, Homo sapiens
gcgagaacacctccgagacggcatctctgcccgcaagattgccgagagggcgcaaggagagcttttcccggatcgggccttgtca

SEQ ID NO: 3018 - DNA, 39 bp, Homo sapiens
ccatcgggcgagtgatccggcaccgccaggactacggag

SEQ ID NO: 3019 - DNA, 34 bp, Homo sapiens
agaagatgctgtcagcgaggccaagtcgcctggc

SEQ ID NO: 3020 - DNA, 161 bp, Homo sapiens
tcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttc

SEQ ID NO: 3021 - DNA, 117 bp, Homo sapiens
accatgccagcaagagtgccaagcgggccctgagcctgcggctcttccagactgaggagaagatcgagcgaacccagcgggacatcaggagcatccaggaggctctcgcccgcaacg

SEQ ID NO: 3022 - DNA, 33 bp, Homo sapiens
gacctggccagtgaccagtcctctccgtccacc

SEQ ID NO: 3023 - DNA, 39 bp, Homo sapiens
tttgtcttctgcggcctcctcacgtgctgctactgctgc

SEQ ID NO: 3024 - DNA, 37 bp, Homo sapiens
tgtggggccaacagttgagcgggagcacgcgcccggg

SEQ ID NO: 3025 - DNA, 106 bp, Homo sapiens
ggttggagccttctggcccaaggatgaagccagagacaggaagtgttctgcaaccccagtccccaaagtgctcctggaacttgtctccctactactgcaggccaag

SEQ ID NO: 3026 - DNA, 25 bp, Homo sapiens
aggctggggcgcgtcgcacactctc

SEQ ID NO: 3027 - DNA, 43 bp, Homo sapiens
tccagcaagcagaaaggcatcctgagtcacgaagaggaggacg

SEQ ID NO: 3028 - DNA, 25 bp, Homo sapiens
ctgtaaaaaatgcctcttctgagta

SEQ ID NO: 3029 - DNA, 52 bp, Homo sapiens
aaaagccccactcgttcttgtctccctcctggtccagttggggtagaaatgt

SEQ ID NO: 3030 - DNA, 94 bp, Homo sapiens
cattgcttaaacgcagaaggcctttgggagagaggacatccttttgctaacttccggtttccatcctggcactgcaccgttctggtgtgccaac

SEQ ID NO: 3031 - DNA, 132 bp, Homo sapiens
ggggctggcaacagcttcgtaatcctggcttcctgctttctgggtcaaagccctggtggtgtgttcttgatatcggtccatctagtggcgttgtttgattcctcccaccttgctgatcattcgtagtgtagc

SEQ ID NO: 3032 - DNA, 26 bp, Homo sapiens
ctttccagaattagaccagcagctac

SEQ ID NO: 3033 - DNA, 31 bp, Homo sapiens
ctccatagtatgatgggcggtagcagccata

SEQ ID NO: 3034 - DNA, 39 bp, Homo sapiens
atagccacagaacccatagccaggggtgccatagtagtt

SEQ ID NO: 3035 - DNA, 43 bp, Homo sapiens
aggaggaccctgcgaaagctgcgacgactatcttcccctgggg

SEQ ID NO: 3036 - DNA, 26 bp, Homo sapiens
tggtaccacctcccgaaaatgtcaga

SEQ ID NO: 3037 - DNA, 124 bp, Homo sapiens
gtgggctatgattcagcaggtccaggtacggagcgagtgcacaggtgtccggctctgcagaaaggcattcccgctgcctgggcctcaggtacacggctctggtgttgacggtgcaccaagccca

SEQ ID NO: 3038 - DNA, 348 bp, Homo sapiens
aggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatg

SEQ ID NO: 3039 - DNA, 48 bp, Homo sapiens
cagttggattatatgggaatggcttcaagtcgggttctatgcgtctgg

SEQ ID NO: 3040 - DNA, 108 bp, Homo sapiens
ctcatggaagctgttgtagtcaacttcgtagaacccgtcctccagggtcaggacaggtgtgaaccggtaaccccacaggatctcactggtgatgtaggagcttcgagc

SEQ ID NO: 3041 - DNA, 30 bp, Homo sapiens
tgatatgagctgctgggtccgggacagtct

SEQ ID NO: 3042 - DNA, 24 bp, Homo sapiens
ttcccagggatccacaatcttcta

SEQ ID NO: 3043 - DNA, 123 bp, Homo sapiens
ttggaaccgagctggtgtcagtggtggtggtggccagcttccccagaaccagctccatgatccgctcatctggcgttgcactcacaggctcatccggagggacctcggtaatgatctctgcca

SEQ ID NO: 3044 - DNA, 81 bp, Homo sapiens
cgggaagttcaatagtggtgagttggtggccattatgggtccttccggggccgggaagtccacgctgatgaacatcctggc

SEQ ID NO: 3045 - DNA, 91 bp, Homo sapiens
ctcgctgatgaaagggctcgctcaagggggtcgctccatcatttgcaccatccaccagcccagcgccaaactcttcgagctgttcgaccag

SEQ ID NO: 3046 - DNA, 24 bp, Homo sapiens
caggcccacgtactcctcagcaga

SEQ ID NO: 3047 - DNA, 135 bp, Homo sapiens
acagacttcgggaagaagcaccagggcacttcaaagatgaagttggagaagcagcacttccgagaggcgcattcctcggggctgatgcccgggtagccacagtttcttcggtctgagacctccatgacgcactga

SEQ ID NO: 3048 - DNA, 27 bp, Homo sapiens
agaaaataaaatgccgcgcagcccttg

SEQ ID NO: 3049 - DNA, 83 bp, Homo sapiens
cacccagttctcctgtgtggcggtggatgcgagcggtgagatcgtctctgcaggggcgcaggactcctttgagattttcgtgt

SEQ ID NO: 3050 - DNA, 80 bp, Homo sapiens
gggctgaagtccagatctttgctcctgacgtccctcagatgcacgtgattgaccacaccaaggggcagccgtccgaaggc

SEQ ID NO: 3051 - DNA, 180 bp, Homo sapiens
aagccccgcatgttcaagaagacggtgtcattctgcagagcctggtccagcaggctgttgtccgtcttattgatccagtacacgttgggcctggggtagccgtttatggatgtacacgtgaaggtgagctcatcctgggaggggctgtggggggcgctgacgacgggcacgctgaagttt

SEQ ID NO: 3052 - DNA, 80 bp, Homo sapiens
gatgagcagcgtctctccggagcagcagatggagcagtaggattggtacccgtcatcgtcgtacaggaagagggcatcca

SEQ ID NO: 3053 - DNA, 56 bp, Homo sapiens
ctggggaacccctagccggcatggacacgactcttgtctacaagcacctgccggct

SEQ ID NO: 3054 - DNA, 33 bp, Homo sapiens
ggcagcggcctacaacctggtccagcacggcat

SEQ ID NO: 3055 - DNA, 68 bp, Homo sapiens
ctgctggaagccacgcctgacacgccggcctgcgtggtcaccctctcggggaaccagtcagtgcggct

SEQ ID NO: 3056 - DNA, 176 bp, Homo sapiens
atcttttattagggaggacagcctgcaaaatcctccctttaagagcccaggccagcctagaacctccagaccacagaaggggagtcctggggacaggactggtgtagacaggcatctccaccgccccggttagccagtacctaacacccactcctgccctcggccgatgtggcaaa

SEQ ID NO: 3057 - DNA, 27 bp, Homo sapiens
cgcggccgccatggaccccatgggaga

SEQ ID NO: 3058 - DNA, 48 bp, Homo sapiens
aagccgcccccgacagaatatcggccgccgattgtccgggccagaact

SEQ ID NO: 3059 - DNA, 62 bp, Homo sapiens
aggccagcacgtccgcggtgaccgggaccagtcccctccgggctggcacaagtgtgggagca

SEQ ID NO: 3060 - DNA, 75 bp, Homo sapiens
ggtgatgaagctctcccctggccgtatctgcgccatgaagccgtagaagcaaaggtagcacacgaggtgccgcca

SEQ ID NO: 3061 - DNA, 386 bp, Homo sapiens
caccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgct

SEQ ID NO: 3062 - DNA, 30 bp, Homo sapiens
accccaggcacgcggggaccaagaggagac

SEQ ID NO: 3063 - DNA, 27 bp, Homo sapiens
ggtatcaaggcaacagtggagccccag

SEQ ID NO: 3064 - DNA, 154 bp, Homo sapiens
tggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccaca

SEQ ID NO: 3065 - DNA, 26 bp, Homo sapiens
ctctgcccggacgctagccggcctgg

SEQ ID NO: 3066 - DNA, 86 bp, Homo sapiens
atgcgcccgtgtttcatctatggatagagctgagccgaagaaagacattgccacagccaacagcaagaagcacagggctggccgct

SEQ ID NO: 3067 - DNA, 120 bp, Homo sapiens
ccggccgtgacgaaggcacgccggggtgacctcaccctccaacatggcggcggcggtagattagggccgcgggtcggagcactcaccgccgctgggggaccctgtcggaagcaactgccg

SEQ ID NO: 3068 - DNA, 24 bp, Homo sapiens
cagcgggacgaagcggggaatgca

SEQ ID NO: 3069 - DNA, 40 bp, Homo sapiens
agagcgcgcccttcgccgttataggcagcaacacggtggt

SEQ ID NO: 3070 - DNA, 119 bp, Homo sapiens
cggcaagcgtccagcgtggctggcccccggccaggatgctgctccggcagaagcccacactctccaagcacacggagtccacgacagcgctcctgccctccgcgaggtcccacaggcac

SEQ ID NO: 3071 - DNA, 89 bp, Homo sapiens
tgagaagaggagcgggcgcccctgagcctgggctccttcgcagaagtgcagcgcatgcaccggtgactgggtgcctcggaggacaaact

SEQ ID NO: 3072 - DNA, 53 bp, Homo sapiens
cagctgttgccaggccattggcaggggctgcccactgcccatgccaccactga

SEQ ID NO: 3073 - DNA, 25 bp, Homo sapiens
tcctggaggctgtggaacggagcca

SEQ ID NO: 3074 - DNA, 27 bp, Homo sapiens
cctctccgctcccgtgtgggcccgcag

SEQ ID NO: 3075 - DNA, 632 bp, Homo sapiens
tctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccag

SEQ ID NO: 3076 - DNA, 31 bp, Homo sapiens
tgggcagcccctcggtcagtccagcagcccc

SEQ ID NO: 3077 - DNA, 55 bp, Homo sapiens
tgggaatccccgagccaggcgacgtgcagggtcgctcctgcaatgagcgcacaca

SEQ ID NO: 3078 - DNA, 438 bp, Homo sapiens
taaatttagcccagtccaggaactggacagacaccacttgtttggcccttttcagttaaaactatgggtccagtacagttcaaattatagatattagggcttcttccccttgggaaacttgctttacagctgtggctgagaatatggccagttcattctccactaacggctagccagaagggagaggagagggaatgaatcaaattcacctttagatcacagaacaggaagtcagctagtaccaggcaccattctattaattttattgctatttcacctcaaaccaatgatacatgacggctgtttgatgtctgcaggggcccttcaccaaacaaaaccattttactttgaatggtttggcttccttggatgttttcaggtaggtaaagatactctgaagcagtgttccttttgacctggccccaagactagaatgaa

SEQ ID NO: 3079 - DNA, 208 bp, Homo sapiens
gcacttctgggaattcggcagcaagtgggccagggcataacaaagccattccagtctgactagagttaaccatgaaatgctgaatgcatggaaaaagctgtaaagaaaactaagtatttcaaaaattctatgaattctgtatatagaaaaaagagctttcaagcttaggagtaacatgaaataccaaaacaataaataggtgccaggg

SEQ ID NO: 3080 - DNA, 26 bp, Homo sapiens
atgttgggagttataaccttgtctcc

SEQ ID NO: 3081 - DNA, 180 bp, Homo sapiens
gatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttca

SEQ ID NO: 3082 - DNA, 26 bp, Homo sapiens
cgcggctcggcaccaacctgatgacc

SEQ ID NO: 3083 - DNA, 161 bp, Homo sapiens
actaaagccgtagccaacagagcagtagtaatccgcgtcgtcttcaggctgcacgggactaatggtgaggacacaggcattgtgggcctcatccttggctgccgagaatcgatcggggatgtcagcaggccggtggtgatcctcctccgagcggtagtaga

SEQ ID NO: 3084 - DNA, 88 bp, Homo sapiens
agcgcccctaaggagctccgaggagctgtggccatgagctcagccatctttacggctctggggatcgtgatgggacaggtggtcggac

SEQ ID NO: 3085 - DNA, 76 bp, Homo sapiens
tttaatcagatccacgatgcgcagctcgaagggaatgtcgttcttcttggcaaagatgtaaacagcgcggcagggc

SEQ ID NO: 3086 - DNA, 147 bp, Homo sapiens
tccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagg

SEQ ID NO: 3087 - DNA, 143 bp, Homo sapiens
gagagaacttctttcctgtgacagtggtgcccacagcccctgaccctgtgccagctgactctgtccagcggcccagtgatgctcacaccaagcctcgccctgcactagctgccgccacaactattatcacctgccctccgtca

SEQ ID NO: 3088 - DNA, 103 bp, Homo sapiens
cgagggagccgtgctccactgacgccaatcccagggagtaggaacaagccaggtcagcgtgttcttcttcctctcactctccaagcgagactgcgcctgcggg

SEQ ID NO: 3089 - DNA, 39 bp, Homo sapiens
tggcggaacagcacggagcacccgaacaggctgcagctg

SEQ ID NO: 3090 - DNA, 43 bp, Homo sapiens
agcgtggcctgacagcgtacggccggcacaagagaggctcgac

SEQ ID NO: 3091 - DNA, 64 bp, Homo sapiens
tgcagtcctggttgagctgtactctgtccctggccacagatactatgaggactccttctcgaca

SEQ ID NO: 3092 - DNA, 126 bp, Homo sapiens
tttacccgagatccagaatggctggaaaaccacttctcacacggagttggtgcggggagccagaatcacctaccagtgtgaccccggctatgacatcgtggggagtgacaccctcacctgccagtg

SEQ ID NO: 3093 - DNA, 210 bp, Homo sapiens
actctgggctagtggacgatcaggttctagaaaaaatgccaacttggaagcttgtggcaccaattcaagctgggatggaacagcaggagatatgaaatacctcaggctcagtatggcagagagggagccaagcccgtcccggccccaacactaccgattaaatacagttctttatcaagtgctctgggtctgccgacctgaagaactaac

SEQ ID NO: 3094 - DNA, 24 bp, Homo sapiens
aggactctgctggtgtcagcctgg

SEQ ID NO: 3095 - DNA, 59 bp, Homo sapiens
tgctcatagggctcaaactcaggagtgctagaagtcaggcctcgggcttgtctctctct

SEQ ID NO: 3096 - DNA, 88 bp, Homo sapiens
gccgggcaccgacagagcggtccctccccccgccccccggagtccccgcgccccgcagcccgagcctccaccgagcacgatccgctcg

SEQ ID NO: 3097 - DNA, 120 bp, Homo sapiens
caagtcgtagacggcgccgtcgagcagcaccgcgggtcggtagaggcgcggcccgtccgtgggccggtggcgctcggggtagtcaccgaacaggaactggcggatgatggccgtcttgcc

SEQ ID NO: 3098 - DNA, 150 bp, Homo sapiens
catgcggaggaaggtgagaaaaacacttcgatggaggcgcttctgcatgtcaacaacctcaggggctgaggccaccccctcgtcgaatttgcgggggacatagcgcaggtaggagtccaggcacttctgtagagtctcgtcaaagatcac

SEQ ID NO: 3099 - DNA, 26 bp, Homo sapiens
agcctgagttccagtgagccatgact

SEQ ID NO: 3100 - DNA, 113 bp, Homo sapiens
aaattcccagaagtcgcctgcgaccgcctccctgcttcaaacaccagagagggcccggggtcctggccggagacaggccgaacctccggagctgcttctgcacccggtacatt

SEQ ID NO: 3101 - DNA, 169 bp, Homo sapiens
gtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcg

SEQ ID NO: 3102 - DNA, 44 bp, Homo sapiens
gctccgcccagtcagccgagagcagcagcgttgccatgactccc

SEQ ID NO: 3103 - DNA, 367 bp, Homo sapiens
caatggaatgtacccaggagcccctaatcccccattgatttagtgttcgggcttggtcagcagtcttcttgtcccactgcaggcatgtgcagccccggctctttctgagttaagccagggactgaaatgggtcggcagaatgctcatctgttgggcgctttatggtttataaagccctttcccttctgtgccctcctcacaaccccatggagactctgcacggcccctccagctcttagaggctgcattttgcgcagtgaaggccacattaaatattaacagggcagctcctggccccgctgtgacgtcaattacggggccgcttggtgagggctgcggatgcctttccaaggtgaagcggtgaccg

SEQ ID NO: 3104 - DNA, 30 bp, Homo sapiens
tgcaagctccactttccaggttcacaccat

SEQ ID NO: 3105 - DNA, 90 bp, Homo sapiens
gaggtaccgctcggactgcaccatatactgtccgccctctgcccctcaaatgggctcctctgaaagcggctgccgtggtggctgcagtag

SEQ ID NO: 3106 - DNA, 36 bp, Homo sapiens
gaaggtgccatcagggaggctgtagacacggatgac

SEQ ID NO: 3107 - DNA, 97 bp, Homo sapiens
gacggaggaagtcagagatctgaagcacaagaaggatctgatgtgctgttgctatcttggagatggagggggccatgtgacaaggaatgcaggtggc

SEQ ID NO: 3108 - DNA, 26 bp, Homo sapiens
ttgctttctgccaccattgcaagttt

SEQ ID NO: 3109 - DNA, 34 bp, Homo sapiens
cgatctcctgatgtcaagtgattctccgcctcgg

SEQ ID NO: 3110 - DNA, 35 bp, Homo sapiens
gtgcttctttgacggggccgccgtgctcagctgct

SEQ ID NO: 3111 - DNA, 126 bp, Homo sapiens
aggggctcggcagcctccacaccaggcaccactgccagattcccgtgcccgaccccgcgacccacggccaatacatcgtctctgttcagccaaggagggcagagaaacacataaagagctcagtga

SEQ ID NO: 3112 - DNA, 1049 bp, Homo sapiens
acgggaaggagatacctgcccctgccaccgggaccccgtcccaccagccttggggagcagtgggtaatggaggaccagcagcacctgaacacccagaacacaggcccccatgagctctgggtctgctttaaaacctatgtacacatctctccccgcctgggctggactggccagtcactgagggcaggggcagggcctgtgtctgaccccctcacccttcccgggacccagcacagagtgagtgctcagtgtttaatgaatgaataaatgaacggtggctgcagtggtgcaggcctgagcaagagaagagggggaaggggtaaagagaacatagcacggggagccctggagggatgagagaatttaagaatgttggaattggccaggcacggtggctcacacctgtaatcccagcattttgagaggccgaggcgggtgggtcacctgaagtcaggagttcaagaccagcctggccaatatggtgaaaccccatctctactaaaaatacaaaaattagccaggcatggtagcaggcgcctgtaatcccagccactagggaggctgaggcagaagaatcgcttgaacccgggaggcagaggttgcagtgaactgagattgcaccactgcactctagcctgggcaacagagcaagactctgtctcaagaaaaaaaaatgttgggagaattctagaatgtggggaggattccagaatgttcagaaagtactagaatattgagaaagtcctagaacctggttgctccagtgtggttcatagactgaccccatcagcatcacccaggaacatatgagaaacacagaatcctggacccactcagacctgctgagtcagaatctgcatttaacacgaaccccgggtgattcgcatgcatttccaagtttgagaagtgctgggctacgaggctgggaaagttctagaatatttaggttagcaagcttcttaaaataggtccaagagagaagagaggagcagaaataggctgggagggatgatggcagccaagatagaagcagggtctccccagaatgc

SEQ ID NO: 3113 - DNA, 78 bp, Homo sapiens
tcttcctcacgctgccggcggaggatggagccggcactgggggggaagggcaggatggagagccgattgatctccttt

SEQ ID NO: 3114 - DNA, 145 bp, Homo sapiens
gtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtcc

SEQ ID NO: 3115 - DNA, 98 bp, Homo sapiens
tcactgtgcccgttttacagacaaggccactgagctctgagaggttatgtgacttgcccaaggtcaccccgcctgcaggtctcaaaggtgggatttga

SEQ ID NO: 3116 - DNA, 139 bp, Homo sapiens
gagaatgcaccgtccgcctaggacagcggttctcaacggggtccattttgtcccccttggggacatttggctgtgtctgggaatacttctggttgtcacaactaggacaaactaactctctagaaaaaacgtgtgtgtg

SEQ ID NO: 3117 - DNA, 78 bp, Homo sapiens
cactgcctggcctacgccaactcctgcctcaacccgctcgtctacgcgctcgcctcgcgccacttccgcgcgcgcttc

SEQ ID NO: 3118 - DNA, 104 bp, Homo sapiens
gcagccttggacggcacagtggcagctggcgatgagatcaccggtgtcaatggcaggtcaatcaaagggaaaactaaggtggaggtggcgaagatgattcagga

SEQ ID NO: 3119 - DNA, 121 bp, Homo sapiens
gaagccacgggctcggcggcactgcggagccggttggcagtggcccccgtgggtgggccagggggcagggctcgggtcgcggacccccgtagctgccccatcctctcctcgcgttcgtgtt

SEQ ID NO: 3120 - DNA, 99 bp, Homo sapiens
agtgctgttgggtgacaaggccttgggcacatgctctaaggtaacggctgtggggcggatgcgggcagagaggcggaccacggcgaagccttgtggccc

SEQ ID NO: 3121 - DNA, 79 bp, Homo sapiens
tgagccggcatgccaccttcgagaacttcggcatggccttcctcacactcttccaggtctccacgggtgacaactggaa

SEQ ID NO: 3122 - DNA, 108 bp, Homo sapiens
ttaagccaaccaacggccgccagcccaattggcagctctccatcgccaccagtcaatggtggcaacaatgccaaaagggtggcagtgccgaacggacaaccgccaagc

SEQ ID NO: 3123 - DNA, 25 bp, Homo sapiens
actcgccctctcatcctgttgggcc

SEQ ID NO: 3124 - DNA, 34 bp, Homo sapiens
tttgcaccgacatacgcctcctggcaaacctcaa

SEQ ID NO: 3125 - DNA, 62 bp, Homo sapiens
cgggaggtcgagagagactttgcctccgtgtattcccgtctggtgctctgtaagaccttcag

SEQ ID NO: 3126 - DNA, 82 bp, Homo sapiens
tttcctggcgacgcggccctgcaggcggttgcgttccccgtcgttaccctctttctcttcccgacgcgtgagttaggccgta

SEQ ID NO: 3127 - DNA, 231 bp, Homo sapiens
cagactcgccctgccttggacatgtgtcaagagatggagcagctgctgcttcactcacaggaaaggttggtgtcactggagcctgtcatcagtgtgaggtctcgccccacctccatgaccttaaccacctctcttccaaacttactttcagctgagaggctgcagttctgcccccagagagctcctgcctgatccttcccaccaaacactgagaatgtgcacttggaagtc

SEQ ID NO: 3128 - DNA, 95 bp, Homo sapiens
aggagagcatgccttttgctgtggtgggaagtgacaaggagtaccaagtgaatggcaagagggtcctcggccgaaaaactccatgggggatcatc

SEQ ID NO: 3129 - DNA, 51 bp, Homo sapiens
tggcggtgaatcagagccacaccgagaaccgccgcggagccctcatcccta

SEQ ID NO: 3130 - DNA, 1747 bp, Homo sapiens
aaacaggcccggagttcattcaaatccagcctctgggagcaggggccttgccactcggttatgtgagcctgctaaagccctccttgccatgtgtgcttgcaggcgggggcccagaaccaagttgggaggccactggctgtcctgtgggaccagagaagtctggtgccaccctagcagggccaagggacttcttctggacgtcagtctgtgcccagcctctaccaccagctttcccttccctgcagggaggggcatgacctgcagaaccaaaggtgcttctgtgagccagtagcccagtgctgcttgggggcaggggcggggcctgtgccttgggttcccccccctccctgggcacatttggggttggggcagcccacacggtggggtgggaagattgacctgcccattttacaaatgagcaaaggtgggagaactcagggagacatgggggagcagagggaggaagcagagcccaacagcccggggcacccggaccccagccactgcctgcctgtggatgggtttctggccacggtgcagggctactgcgaggaggaaatgagggtgatgtgggcacctgaaacagcagaaatggctcagggccaggcactggggagccactgtccccatggggcttgagcttctgcctcagagggaccttccggctgccattgagggtcccagcaccaaaccccacagctggaccacttgggacctcaatccacagggggccagggctgcggcctatggcagataaagatagaggaggagggctggatgaagccacaggtggtgggcacaggataggccagacagaagggactttgggggactccaccttgggtagaaggagggacagctgaggtcctgtggtggagaaggcctggagcagagggtgaccaaggagatgacagagtgcacgtacagggccaggccaatgggagtgggaacccttgggagagggagcttcaggccattcattcagttcctgtttagccagcaccctcctcccctcatctgtccctctgccctcaccccaacatgccagaatctccttcctctccagcttgtacccaagccctctctgctccatgcccccagcctgctgaccacctctcagccatgtcctgggcctccagatctgtccctgatcctagtcttgcctctgaggggtccatcatccttgtctgtcccccagacctcccacgccagcccctgctcccaccctgcctggctgcctcgtgcctctggcccagctgggtaggtagggatttgcatagctgctccccagctcctccatacctcggctccccacacagcactgctaggcgcccctgcagggtcctccctcagctcagaggctgccctactggctgaggtgcaggctggtgccaagagagcatgctgctctgtcagcatgaggcagtgagcagggctctgggcaagggtggcatccaggaaagcccttgaagactgaggggcgctttgctggttgggccaagggaggaagggcctgcctggcagaaggaacagcctgggcaaaggccccaagatgggaaagccttggtggttggggcatagaatgggggggcagtggggccggccaagacaggaagggccttgaatgtgagggtgaaatgatggggtgtccctgggggccttactcccaactcagatcaagtcctttggtggcaggggctgccccggtcctctgacccagggcaagctctatgagcggtggagccca

SEQ ID NO: 3131 - DNA, 66 bp, Homo sapiens
atgcccggcccgtgattggctcggaaccacctcaggtcctccactgcatcagctgctctgatgctc

SEQ ID NO: 3132 - DNA, 65 bp, Homo sapiens
cctggtggttctccgaggcgtacaggcgcccatcgcgcacgatgtcctctatgagttgctggtag

SEQ ID NO: 3133 - DNA, 39 bp, Homo sapiens
agcagcggctgcctggcggtctcctttgctcgtgcctgg

SEQ ID NO: 3134 - DNA, 65 bp, Homo sapiens
taaagattccgtgctcgggcaggcagggctggcgctggactagtcccgttggaagctggatgcac

SEQ ID NO: 3135 - DNA, 25 bp, Homo sapiens
ccttaagttctttataacgatccag

SEQ ID NO: 3136 - DNA, 24 bp, Homo sapiens
cagtgtcatgtgaggacgtgcttc

SEQ ID NO: 3137 - DNA, 1129 bp, Homo sapiens
ctggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttctta

SEQ ID NO: 3138 - DNA, 60 bp, Homo sapiens
gcactggccgttggtcttattacagtcgggatcaaagcctttgctgacggcacagtggca

SEQ ID NO: 3139 - DNA, 38 bp, Homo sapiens
cgaggcggcggcatcagtggagatccacatgctgctct

SEQ ID NO: 3140 - DNA, 24 bp, Homo sapiens
gcggctgccacgtcaatgtgcaga

SEQ ID NO: 3141 - DNA, 57 bp, Homo sapiens
tttaatgttgcaatcaccagacccaaagctttgctgatagtgctgggaaacccccat

SEQ ID NO: 3142 - DNA, 115 bp, Homo sapiens
gtgcatcctagcccgcccgaggcccctgccaccccccatgggggtctgggcccggcctcgcctgccctcctgggccagtcacccctcccccagcccacccaaataaaggattatt

SEQ ID NO: 3143 - DNA, 95 bp, Homo sapiens
gcgctcggggcttcgctcgcggctgcccgactcttgcccctcggtcgctgttccccgtcgccggcgccccgctctacgttgtcgggcgccgccat

SEQ ID NO: 3144 - DNA, 25 bp, Homo sapiens
cggggcctgcttcacccgcgtgcag

SEQ ID NO: 3145 - DNA, 143 bp, Homo sapiens
actctggttctagaaactcgcctgcagccgctggctggaccagcacacgctgacggggccggactatttacaggcccattgcgggctgtaccttggccacctcccggcacggtgctcagctgtgacgccaaaataagttaggg

SEQ ID NO: 3146 - DNA, 42 bp, Homo sapiens
tgcagcaggcgcaagaccaggcttgtgaaccacgggctgtgc

SEQ ID NO: 3147 - DNA, 591 bp, Homo sapiens
ctacctgcgcacctgcatgtgttcaacccccgggagaacacctggcggcccctgacccaggtgcccgaggaggccccgcttcggggctgcggtctctgcaccatgcacaactacctgtttctggcggggggcatccgtggctccggtgccaaggccgtctgctccaacgaggtcttctgctacaaccctctgaccaacatctggagccaggttcggcccatgcagcaggcccgagcccagctcaagctggtggccctggacgggctgctctatgccatcggtggcgaatgcctgtacagcatggagtgctacgacccgcgaacagacgcctggaccccacgcgcgccactccccgcaggcaccttccctgtggcccacgaggctgtggcctgccgtggggacatctacgtcaccgggggtcacctcttctaccgcctgctcaggtacagccccgtgaaggatgcttgggacgagtgcccatacagtgccagccaccggcgttccagcgacatcgtggcactggggggcttcctgtaccgcttcgacctgctgcggggcgtgggcgccgccgtgatgcgctacaacacagtg

SEQ ID NO: 3148 - DNA, 116 bp, Homo sapiens
ttggagaccaagtaaaggcagaagaggtgcctgtcgatccctgccccggtcatggccaggcggtacatattctggtgcttcttagcagccttctggaagagatctcgcaggtctgc

SEQ ID NO: 3149 - DNA, 53 bp, Homo sapiens
tcagagagctggaggcgtggcaggcagggtctgcagtggtatcactgtgggca

SEQ ID NO: 3150 - DNA, 24 bp, Homo sapiens
tgacggccgcctcctgaagctcca

SEQ ID NO: 3151 - DNA, 127 bp, Homo sapiens
tttagaatgtcaaaattgattttgtaatagtcaggacaggataaacagtcgctatattaagaccatgtacgtgtccctagacctagttctttccctacgtctgtttttataaatgctggtgataaac

SEQ ID NO: 3152 - RNA, 23 nt, Homo sapiens
aacauucauugcugucggugggu

SEQ ID NO: 3153 - DNA, 63 bp, Homo sapiens
cctggatgatgataagcaaatgctgactgaacatgaaggtcttaattagctctaactgactaa

SEQ ID NO: 3154 - DNA, 134 bp, Homo sapiens
ttggcccttatcgaagctgcagctgcttccgcatagctgctgtggtcaaaaaggagcccagagtgacagttttccttgacggtcgccgttctgtttgttgtaactgatctgcaacattttgggaaaatacagtt

SEQ ID NO: 3155 - RNA, 22 nt, Homo sapiens
gcccaaaggugaauuuuuuggg

SEQ ID NO: 3156 - DNA, 129 bp, Homo sapiens
actggaggactaagaaggctgagtctgatgaagtaagactttgctgatacattcctcctagaaaaaagggttggagagagcagccttcactgaagagtatcacagggctgactgtactacccaacactc

SEQ ID NO: 3157 - DNA, 119 bp, Homo sapiens
atgcaggtactgttataactgaagtgttttacggttttttcttcctgcttaaagcacttggtacataagtatctctaactcgattccataataagacagagacgcttggtctcaaacat

SEQ ID NO: 3158 - RNA, 22 nt, Homo sapiens
ugugcgcagggagaccucuccc

SEQ ID NO: 3159 - DNA, 133 bp, Homo sapiens
ttatcagctgggataatctttacctgttccttcttttggagggcaaattaggacatgattggggttcacatagtatgcgattaacgtctctgagtaatcaggacttccagtaccctgattgtgcctatctgat

SEQ ID NO: 3160 - RNA, 22 nt, Homo sapiens
aaaucucugcaggcaaauguga

SEQ ID NO: 3161 - RNA, 21 nt, Homo sapiens
uucaaguaauucaggauaggu

SEQ ID NO: 3162 - DNA, 137 bp, Homo sapiens
taccaaaagttagctttttggggggcaggtttttaagtaacctttgccaacttgggctatttggaagagtaaaagaccacactccacagtgggctataccacttagtatagttcgctactattttgtggcctacatg

SEQ ID NO: 3163 - RNA, 21 nt, Homo sapiens
aguuaaugaauccuggaaagu

SEQ ID NO: 3164 - RNA, 22 nt, Homo sapiens
aaauuauuguacaucggaugag

SEQ ID NO: 3165 - RNA, 22 nt, Homo sapiens
aaaaguaauugcggauuuugcc

SEQ ID NO: 3166 - RNA, 20 nt, Homo sapiens
auguauaaauguauacacac

SEQ ID NO: 3167 - RNA, 23 nt, Homo sapiens
aguauguucuuccaggacagaac

SEQ ID NO: 3168 - DNA, 125 bp, Homo sapiens
gcgctcactaaggctcggtcctctccacgtggtcctgacctgtcctctgtgagcaagagaaacaggactggtttgggggtgtcctgtctcagtggacacaggacaccacggttttcagtacaaca

SEQ ID NO: 3169 - DNA, 69 bp, Homo sapiens
tagcatatgatggaaaaatcttaatcttctgagacttgtgatgtcttcaaaggaaccacttcaatgcaa

SEQ ID NO: 3170 - DNA, 125 bp, Homo sapiens
gtgacatgtatgtttttgtttaacttgtatacaaaggcttatggataggtgcaaaaataaattctcttttgcaacccagaactcattgttcagtgtgagttttgatacatataagaagggatatt

SEQ ID NO: 3171 - DNA, 126 bp, Homo sapiens
atacctaaacccaagaatcactttcttatagtgatgatttaaacagatgcaaacagcgagcacatcttgtcacctttgcgggactgtggctgtgcccctcgcagtaaatttggaggttctacatcc

SEQ ID NO: 3172 - DNA, 63 bp, Homo sapiens
gcggtgatgaccccaacatgccatctgagtgtcggtgctgaaatccagaggctgtttctgagc

SEQ ID NO: 3173 - RNA, 21 nt, Homo sapiens
ucuuguguucucuagaucagu

SEQ ID NO: 3174 - RNA, 22 nt, Homo sapiens
uagcaaaaacugcaguuacuuu

SEQ ID NO: 3175 - DNA, 204 bp, Homo sapiens
tttccagcagtagtcagccatccggacagaaccgttcctgtgatggtgttacactgctgggagaggaatgtcttgtcttcatccggttgcctgcgccactgttctggtggcgtctggcactggtgcaagacagagctgtgcttccccgagagtgtgctaagcattcactttggctgcttagttctagtctgggagcagacagag

SEQ ID NO: 3176 - DNA, 133 bp, Homo sapiens
aagccagccaatgaatctgcttacctgattgtgtttgtgcagacatactttaaaaactggcaatagtaaagccatgttacgagccttaaggacattgaagtcgttaaggtccctgagaatggctataacaaat

SEQ ID NO: 3177 - RNA, 21 nt, Homo sapiens
uccucuucucccuccucccag

SEQ ID NO: 3178 - RNA, 23 nt, Homo sapiens
ucaagagcaauaacgaaaaaugu

SEQ ID NO: 3179 - RNA, 20 nt, Homo sapiens
agaccauggguucucauugu

SEQ ID NO: 3180 - RNA, 23 nt, Homo sapiens
agugccugagggaguaagagccc

SEQ ID NO: 3181 - RNA, 23 nt, Homo sapiens
caaagugcuguucgugcagguag

SEQ ID NO: 3182 - DNA, 132 bp, Homo sapiens
tgggtttggattatgacaggcccatccccctggacctctcatagtgccccatgccagagcaaactgtggccccgaaccattgcctggcttctgtacccgtgggccactggcactgaagagggttacacagtg

SEQ ID NO: 3183 - DNA, 156 bp, Homo sapiens
tctcgtggtagttttctttttggcacatttgttaagttttcaaatgggcctaacactgccacatgtattatactggagttggcaaaggcctgtgacaatgagatatctctcaagcctttcacgcctttcctctatcagagaatggctcccacatgt

SEQ ID NO: 3184 - DNA, 76 bp, Homo sapiens
acaatgatgacttaaattactttttgccgtttacccagctgaggttgtctttgaagaaataattttaagactgaga

SEQ ID NO: 3185 - DNA, 131 bp, Homo sapiens
agcctcctggtgtttaacacagctgtgttcttatactgactgtgtagaaagagaaggaaataaaccttaccccatatgcatttcatccccggaccctgcacctcgtctatattgtgaatagggaaatatgg

SEQ ID NO: 3186 - RNA, 21 nt, Homo sapiens
ucgaggagcucacagucuagu

SEQ ID NO: 3187 - RNA, 22 nt, Homo sapiens
auccgcgcucugacucucugcc

SEQ ID NO: 3188 - RNA, 22 nt, Homo sapiens
cuuucagucagauguuugcugc

SEQ ID NO: 3189 - RNA, 22 nt, Homo sapiens
agagguaguagguugcauaguu

SEQ ID NO: 3190 - RNA, 21 nt, Homo sapiens
aggcaagaugcuggcauagcu

SEQ ID NO: 3191 - DNA, 147 bp, Homo sapiens
agttgtggtggttttctttttggcacatttgttaagttttcaaatgggcctaactctgccacatatataatatcggagatggcaaaggcttgtgacggagatatctctcttaagcctttcctgcatcagagaatggctcccacatgt

SEQ ID NO: 3192 - DNA, 128 bp, Homo sapiens
gtgcacatttcattgacctgctttcttttatgtgagtagtgttatttcttatgtgctatacaaataattgaaggctaattagcagtataactataaatagtaatgctgccagtctccttcagacaaaa

SEQ ID NO: 3193 - RNA, 21 nt, Homo sapiens
guucaaauccagaucuauaac

SEQ ID NO: 3194 - RNA, 22 nt, Homo sapiens
aaaaguauuugcggguuuuguc

SEQ ID NO: 3195 - DNA, 153 bp, Homo sapiens
attgcacgttgttggagcttggagttggtgctctaactggctgataaacttgcaagtgtaggtagtatgctatgtgaggggcaaatttttcagtaacatgacaaaggtctttggcctagtgagtagagtttgacaataatcctcgctgcaagt

SEQ ID NO: 3196 - DNA, 149 bp, Homo sapiens
cctccttttcttggcggggatcgggcttgtggtgccgctccccgtaatgtacggaggaagagggaaagggctctggccccctcggcgtcatgtcttcggtgctggcggcttcccatccgctggttctatcctcaaacgccgggacaccg

SEQ ID NO: 3197 - DNA, 63 bp, Homo sapiens
acagatgatgaactcattgacagacatacagagactgtgtgctgattgtcatgttctgactta

SEQ ID NO: 3198 - DNA, 137 bp, Homo sapiens
ggcctcctgggatcccatctggaaagtgcttagtattctgcctgcttcacaaagggagggaaagcaaacgtggtgaggcaccctttccattccagcttgctcggtagctggtgattggaagacactctgtgacagcg

SEQ ID NO: 3199 - DNA, 123 bp, Homo sapiens
gagcactgttcgtaacccgttagcctggctgtagctaatgggttccattccggtgcaatagcatttccagcgacacatgactgactgactggtggctttcagtttcaggtcttggagacaaat

SEQ ID NO: 3200 - DNA, 73 bp, Homo sapiens
gttcagatgatgaatttaactgttcaactgctgaatgataacgggcatgaactaaaacttaattctgacagag

SEQ ID NO: 3201 - RNA, 22 nt, Homo sapiens
aagcccuuaccccaaaaagcau

SEQ ID NO: 3202 - DNA, 205 bp, Homo sapiens
aagactatactttcagggatcatttctatagttcattactaaagaagtctatctgaacatgtagaacacatgacaccataaggaggaggcacaacattctccctagagcctgaagctggctcttggtgtttcatgactacagcagccatttgccactgatgactgttctcttccaggagaataagaaggagaagatgcagtttgg

SEQ ID NO: 3203 - DNA, 75 bp, Homo sapiens
gtcagatgatttgaattgataagctgatgttctgtgaggtacaaaagttaatagcatgttagagttctgatggca

SEQ ID NO: 3204 - RNA, 22 nt, Homo sapiens
cuagguauggucccagggaucc

SEQ ID NO: 3205 - RNA, 22 nt, Homo sapiens
aaguucuguuauacacucaggc

SEQ ID NO: 3206 - RNA, 22 nt, Homo sapiens
ucagugcaucacagaacuuugu

SEQ ID NO: 3207 - DNA, 131 bp, Homo sapiens
tggcaagcctccagcgtgcgtgggtctgtggtgatgtgtgcattcctacactgcttgccagaacagtattgaaatagtggagcgtttgtcctgctccatccagagcaaggttatagaaatttcagacaatt

SEQ ID NO: 3208 - DNA, 126 bp, Homo sapiens
tacccccttttcactttgccagttggacttatgtctttattggtcattcaagtggggcaaaggaaatatccttttaaaactcaggcaaactgggtgtttgtctgtatcctgtcagaggaaacaaat

SEQ ID NO: 3209 - RNA, 22 nt, Homo sapiens
uaugucugcugaccaucaccuu

SEQ ID NO: 3210 - RNA, 22 nt, Homo sapiens
uggugggcacagaaucuggacu

SEQ ID NO: 3211 - DNA, 275 bp, Homo sapiens
aatctgtagtcttggagccgcacagggttggtggtaccctcgagcacaccagacttgcagaaaaagcatactccagaggaagctgaggcatgcctgctcgagagccagctgttccatgtgcaattttcctctgatagtttctggtcactgttgccacggtgataatgactgggctatgtcattatctatccgccaacagtaagagaagctttgcagtcgagatattgtttagcagatggagtgttttctgttgaacactaagtactgccacaagt

SEQ ID NO: 3212 - RNA, 22 nt, Homo sapiens
aaacauucgcggugcacuucuu

SEQ ID NO: 3213 - RNA, 23 nt, Homo sapiens
ucuuggaguaggucauugggugg

SEQ ID NO: 3214 - RNA, 21 nt, Homo sapiens
aucauagaggaaaauccacgu

SEQ ID NO: 3215 - RNA, 22 nt, Homo sapiens
uuguacaugguaggcuuucauu

SEQ ID NO: 3216 - DNA, 74 bp, Homo sapiens
tgagccagtgatgaaaactggtggcatagaagtcaaggatgctgaataatgtgtgtctagaactctgaggttca

SEQ ID NO: 3217 - DNA, 126 bp, Homo sapiens
atgcaggtactgttacaatatgactgaagtgatttgttgtcatttcccctgcttaaagcccttgatatataactatctctgtctaactcattctgaagtaagacagagatgcttggtttcattttt

SEQ ID NO: 3218 - DNA, 82 bp, Homo sapiens
ggatcgatgatgagaaccttatattgtcctgaagagaggtgatgacttaaaaatcatgctcaataggattacgctgaggccc

SEQ ID NO: 3219 - DNA, 97 bp, Homo sapiens
tggatcgatgatgagtcccccataaaaacattccttggaaaagctgaacaaaatgagtgagaactcataccgtcgttctcatcggaactgaggtcca

SEQ ID NO: 3220 - DNA, 82 bp, Homo sapiens
gggtcagtgatgagaaccttctattgtcctgaagagaggtgatgacttaaaaatcatgctcaataggattacgctgaggccc

SEQ ID NO: 3221 - DNA, 98 bp, Homo sapiens
tggatcgatgatgagtccccccaaaaaaacattccttggaaaagctgaacaaaatgagtgaaaactcataccgtcgttctcagcggaactgaggtcca

SEQ ID NO: 3222 - DNA, 67 bp, Homo sapiens
ggatcgatgatgagaataattgtctgaggatgctgagggactcattccagatgtcaatctgaggtcc

SEQ ID NO: 3223 - DNA, 135 bp, Homo sapiens
tgcccctgacctgggaagagaggggcctggctggtggtatccatctcataccagctagggatgaagaaaccgcttgctcatcccagcctggctcctggtctatgcccatgcctggttcgtgccttggacatatca

SEQ ID NO: 3224 - DNA, 86 bp, Homo sapiens
aagacaacgtaaatatatgtataaagagtatcttcaggagacgtaataatgtaaaaatcatgctcaatagaattaagctgaggctc

SEQ ID NO: 3225 - DNA, 81 bp, Homo sapiens
gggtcgatgatgagaaccttatattttctgaagagaggtgatgacttaaaaatcatgctcaataggattacgctgaggccc

SEQ ID NO: 3226 - RNA, 22 nt, Homo sapiens
aguucuucaguggcaagcuuua

SEQ ID NO: 3227 - DNA, 48 bp, Homo sapiens
ctgatgatacttgtaataggaagtgccgtcagaagcgataactgacga

SEQ ID NO: 3228 - RNA, 21 nt, Homo sapiens
agagaagaagaucagccugca

SEQ ID NO: 3229 - DNA, 214 bp, Homo sapiens
aagactatactttcagggatcatttctatagttcattactagagaagtttctctgaatgggtagagcactggaaaccatgaggaggaggcacagtgttctctcctgagcatgaagctgactcttggtgttgcttcactgcacctgccatgtgccactgatgattgttcttgtcttcctctgggagagtaagacggagagcatgcagtctgagtg

SEQ ID NO: 3230 - DNA, 214 bp, Homo sapiens; identical to SEQ ID NO: 3229

SEQ ID NO: 3231 - RNA, 22 nt, Homo sapiens
caagcucgugucuguggguccg

SEQ ID NO: 3232 - RNA, 22 nt, Homo sapiens
cucuagagggaagcacuuucug

SEQ ID NO: 3233 - RNA, 22 nt, Homo sapiens
cucuagagggaagcgcuuucug

SEQ ID NO: 3234 - RNA, 18 nt, Homo sapiens
ugcuuccuuucagagggu

SEQ ID NO: 3235 - DNA, 85 bp, Homo sapiens
cccctatctctcatgatgaacacatatgcctctgagctgctgtgatttctggcttcaaagtaaacgctctgaagaagagatgggg

SEQ ID NO: 3236 - RNA, 22 nt, Homo sapiens
aacaucacagcaagucugugcu

SEQ ID NO: 3237 - DNA, 138 bp, Homo sapiens
tccctgtattcgaaagtgatcgtgggctgcctttgccctggtcattgatagtgcagggagaggaatcaatgaaagcgcttccccgtgtttgaagggtccactcctatcccttccaaactctggagctttcgtacatgc

SEQ ID NO: 3238 - DNA, 136 bp, Homo sapiens
gcccgccttggcctcccaaagtgctgggattcttacatcgactgcatagaaagaggagagaacataacctacctaccccgtacatacttcagcccaggtcctgtgcctcatctgtaatatgaatgaagagacatgg

SEQ ID NO: 3239 - RNA, 21 nt, Homo sapiens
ugcaggaccaagaugagcccu

SEQ ID NO: 3240 - RNA, 22 nt, Homo sapiens
aggggcuggcuuuccucugguc

SEQ ID NO: 3241 - DNA, 68 bp, Homo sapiens
ccgcagtgacagcaatatttttcatccacagttcacctcatgaatgttgtcactttgggtctgagtga

SEQ ID NO: 3242 - RNA, 21 nt, Homo sapiens
caaagguauuugugguuuuug

SEQ ID NO: 3243 - DNA, 133 bp, Homo sapiens
tagcaagcctccagcatgcttaggtctgcagtgaccctatgcatccctacagtgcttgccagaacagttttgaaacggtttgaggccttgccctgctccatccagagcaagggtatagaaatttcagacaatt

SEQ ID NO: 3244 - DNA, 139 bp, Homo sapiens
tacctcccaggatggcatctggaagtggatagtattctgccagctttggaaactggatgaaaagcaaatctggcagaggtacccatttcattcccagcttgctcagtagctggtgattggaagaaactctgcaacagtg

SEQ ID NO: 3245 - RNA, 22 nt, Homo sapiens
ugagguaguaaguuguauuguu

SEQ ID NO: 3246 - RNA, 22 nt, Homo sapiens
uuuugcaauauguuccugaaua

SEQ ID NO: 3247 - RNA, 22 nt, Homo sapiens
cgucaacacuugcugguuuccu

SEQ ID NO: 3248 - RNA, 22 nt, Homo sapiens
uacguagauauauauguauuuu

SEQ ID NO: 3249 - DNA, 756 bp, Homo sapiens
ctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaatctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatca

SEQ ID NO: 3250 - DNA, 7689 bp, Homo sapiens
tcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcaaacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctcctgccacacggacagcgagaacacgtcctccttctcctccccttcccacgacctgcaggagctgagcaacgaagagaactgctgtgcacccatccccatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacctctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttcaaaaaaaaaaa

SEQ ID NO: 3251 - DNA, 8041 bp, Homo sapiens
actttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcgggaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagatactcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggtgtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctggatatatttttaacaataagtttgttagcattatttatttatctttagagagaaaatatttgcatctgtttatttaccctttgaagcattaatacttagtcactcacattgaaattgcatatggatgtatcaacataggctaaaattaaattatggatgtcgcagaaatgaaatacttcatcttagaaggtaaaattttcaagaaagtattttattcatggacttaataatgtcttaagatgaaacaattttatgtccaaatgagaaatttataaaaagacccacatatagtagttgctgaacaaacataattttcttccagctcccatccttcctttttgaaaaattgaatttacccatgtagatgcagctatttacaattatacaagaatgcgaatagattaattatatcttctcatataaaggcaaagaattttatattatatataatgctaaatatttatttgataacacaatattcttagaaaaatagtttattactttaggattttatctataacataaatatattatttgttattacctctttaaattttcattttatacaatttttgagattctggccacacaacattcagaattattgctcatgtaaatttaaatattgctacttattttttttcttttctgaaatgaaaacatgaatcttttggcatctgtttttagcctcccatggaagacagtaagcaaaaccatcactgttggagaatttcaaatcacaacccgacataggagagtagagaaacaaagaaatgagtggatctagaaaggcaaactgaattgctatatttggaatagctaagaaggacctgactttgagaagtgctagaccagggactaggaacgttgcttagataaaaattatggccgattacactgatgcgaaggagaaaacagtgtaacacagaggagaaagttaacagagatagaatctatgatttaattttgcaaatagtttttttagagaacaacatgcatactataaaagaaatgatactattaagaacaaacctacttgttccaactcttaaagaaatattcatggtttagcatttgcctctaaaccctgttagaaatatgtgaagttagaaataaaggtttttttaaaaaaaaagcttttttggtatgtgaactgtatgctgtgctcagtatgtactgaaacatactatcttttattttctttaatttatatattccattcaaattctatattcttaagttagctaccacaacgttttcttattgtttcaatatggtatgtcccaatgaaatgctgtatatatatgtctaaactgtaaaaattatactgcaaatgttgaagttttgtatttatgagagacattgaaagtatggcttacagtatatcaaacttgtcacacttcaccatttgtatattaatagtaaagatacttttactttaa

SEQ ID NO: 3252 - DNA, 2520 bp, Homo sapiens
atttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcaggcacttccgtttcccgcttctggattttcagccaggtgcctggacatggccctaacctgaggctgagcaatttaactagagcctccttcgtgagccactacatccttcaaaaatactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccaggtcaaaa

SEQ ID NO: 3253 - DNA, 2545 bp, Homo sapiens
gctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaa

SEQ ID NO: 3254 - DNA, 5300 bp, Homo sapiens
gtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaactgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgctttatggatgttttattttataaagctcatgtcaccaaaagctgcttctccattttatgtaaaacattgagaatgttttcatgttttctggtgacatgtagggtctgtagtcacccctgcatattgagaaactaggaccacactgcatcggactagtcaggtccatttacatgtccaagaatcttttcttaaattccttactttgttcattcattggctgttcaggcagaaaatggaaacaggtagcttttatgttttttattatagttttccacaaatctaattattttgatagttacaagaagataatgattcatcagtaagctaacataatccctttcatagttcatatt

SEQ ID NO: 3255 - DNA, 3266 bp, Homo sapiens
gcagtcgttgccacccgcggagatgaaatgtgagcctgggtggccaaggacgccggagtggccgccttccccgcgcctgagcgcagtggggcgagacaaagagacctgggcccccagcgcagcccgtctcgggccacgggcgccccagctccgcggagtcccgcagtcgctggcccgggacgcgcccggcccgggctcccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcatgctgctgtcccaggtagaggtgcgagtataacttggagaatgtgaagtcaaactgattctgtgattctttggtcatctggctcctagcttagctcttgattcactaactatatcatggagtgtgctgtgtgccctctttctcactccatagctacctccaccctggggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctgcaggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggacgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctactgccacctaaaaatcatctggctttatagtggatcagaataaaggttattctaactgtggggagaaaaaaaaaattgtatcaagttccacaggtagcagacacttcacttccaagtaaaagatgagaaatcaattattcccacaggattttaggtcagggagcaaaaatctcagaacttgaccatgaagatacacaacagactcgcaaaaataaagtgggaaatgaagttcagattcccttctgtagatttccttaaaactattatttttttcttcttcgtaaaattttgataatctgttctcttaaaaaagttaatgacacaattaagatactgacatcaaattgttgccttttaccaaaatgcaaattttatgaagtgcctacctttatatgtataaagcatttaataaataattctaatgtgccatattttgctgtgagtgaccttaacatttatatttttatatgaattgtttcatgtatttataaaaattgtatattgaacattggaaatagatgattagatttttgtgtcattttacaattaaatctaaaatgcttaatccaatatcatcatcaaaattcagtgaaatcccaaaacagtgccaagaattttgctgaatgaaacaatcaaacaaagcattttaaggtgtaagttatagtacctgtacttgcagataagaagcttactatatcattattataagtagcatatattactttcaaatacctatattagaaagatattgatctgactgaaatataacctacctgccagtaaggtccaaaggctgaatttgttttgaatgagttccttgatctttaagcactgatgattttcttatatatgaggatgcaaagcattcaagagtttcagcctgttctggtgaggggctccctgacttacataaagttttcagtgcaattttaatagtacatatgctttaatttatttttcttctgcgtgtggtcagacccaattacactgtggctaagactctcaaagtgccagggtttctgtgatgattctgagaatgctgaatacaaatataccttatattctttaaggaaaacggaaaggaaagatcagcagaaatagggttttctcatcttcaccatcaataaacatttattgcgtacctcctatattctgcaaattttccccaaatagaagccagttcagtccacaccatctcttctttgagttgtttatggcctcccttaaggcattttacaaacccataagcctacaatagatgagtatttttactatttgtattaagtgtcataatagcatcaatgtgcacattaccagtatagactgttggagttcactgattgttttcatagatgatgcttcttggggaaaaatagtataggatgtgaaagttttgaattacggttatttaaaaactaacatttgctatggccaaagtgtttacaataagcaataaagtgaaagaacctattataacaca

SEQ ID NO: 3256 - DNA, 3318 bp, Homo sapiens
gggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgaga

SEQ ID NO: 3257 - DNA, 3132 bp, Homo sapiens
ctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 3258 - DNA, 3712 bp, Homo sapiens
atgttacaattacctcccaccaggccccaccttcaacactggggactacatttcaacatgagatttggaggggacaaacatccaaaccatatctgatggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggaccccaggacttcttctccccctcaggtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaaaataaaagagggatttgctaagaatatcagaaaaggagtgttccaatttgaagagtattacaattgaaataacatcaaatatgtcacactaagcagccagtaacagaataaataattacaacgaaggaaaaaaaaaggaaagtcctccaaggtcaggatggcatgggaacaggcctagcagggacacaagcctggagtaaggcaggaaaagagccaaggctgactacagcccaccaaccacaatcttcttccctaagaccccaggattgtccccggcccatccccaaaagaagaaaggggctatgtggaaaggtgaggccctctagatgcccctccctgtgacggctggctcaaaaaagactaagtcaggttttttattgaagcctcccttagaagaaagtgtagtagggattccttgtctcctctaccttctccctgacttgttgatatctgaaactccttttaataggaggctttgtttcttattccataattaatgaccgaaaacacaaaggacagtaaggtcttcattccatggagtgactagtcagtcaacaaaagtaaaaatgcctcatttcatcaaatcaacttttccagtaaaggccagagttcaaatactgtaagcatgagaatagaatggagctgtcactaaagagagtacaaggtcaagaaccagaaatgtctccaagctttctgcagtgtgagcaaagatagcctcgactggacaaataacacttctgaccccgtggtacccccacatgactggtatgctgcccctggactttgtgtctctctaaaatcactaccattcactgagatctgaccaggtgaggcactcaccaacgctacagaagcaacacacaggtttccaatcctctcaaacacagatacaacccccatcctccaatgtgcatggaagaactttaaatctcagagagagtaagcaaaatcacacaatttagtggtttagacctattccaaagtcttcttttcactgtaacacaaaacccaacagtatcccacccaatttatgaagtcaaatttgtttgcttaaaaaaaaaatcagctgggcatgggctcacacctgtaatcccagcactttgggcctaaacaggcagatcgcttggtctcaggagctcgagaccagcctgggtaacatgacaaaaccctgtctctacaaaaaaatacaaaaaaaaaaaaatttttttttaaatcaactctttaacagagaaaccttaatcccaaagatttccttaactgttgtggccctactgcagcatagggctccccacttcattcactgtctctcctgcttcaagatgtttcttccctgtggatgaagaaccaggagatcacacacagaaatgggaaaatatctgggtaaaaacattcaaagaatagcacaaaatggtttgggacttccaaataagactctcaggaaagcaggctacagctctacctcaaaacccgccacctcctataacgaaggactggttttccaatggcctatatacacattttgctgcactctacaaacagaaagcaataggcttgaatttcaccatgatatgtggtacacctaccttattattcacttatctttcaaccttccattactttttgattagtaacaaaattaagactcatttctcaaaaatatcagaaaaccaaccgtttcattcttactcgagttcttccagcatgttcattttgaactgtttacctcccatgaaataaaaagtctcttgactctgaaaaaaaaaaa

SEQ ID NO: 3259 - DNA, 8278 bp, Homo sapiens
accatcgagcttcgcggggttgctgggctgacggatccgcgggccggcatctgaagcgagcgggacgcagcgcggccagggcctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctgtagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcagtactgtgcttcagtaagcctgtgcatggaccttagtctctggggataaaacatccagattctaagcctccgtgaatctttgattctgtgagtctttatataaataatgttcttggaacagaaacaatgcaagggacatctgcacagaaatattctttgcttctctccagtttcttattcttgccagcagaatcattgctgctgctacagcttttttcccaaaaatgtctaaaagtgccgaaagtgcagagggagggaaaaaatgagccactaaaagaaggatgatcctttcttgtacctacctcctcagtctcagtgggggcctttccaagtgataatgccagtttatggtttgtaaaacttttccttcaaagagattgaactgaatttggtctccctggcatagcacagccaagttacaacttctcttggctgagcatttcactgaagtttaaagcaaaagtacactaaaaaatttcatttcacttgccatatgttcacaaacattcataatagaacaattcaggggcaagaatacattttaaataaattcattcacatgaaatccctaaacctccaaaaaagtattcatgatggtcagggcagagtgggctataatcaggactataaaacatgttcctaactgctgcaaagccaaaaatcatttattgtttcaatgattaactgtggaaataaacacgctgatcattaaacctcacagaatgatgaacattagggagaaaaactccactatgtcacatctctgttaccacctgtgtagctgtggagagtgataaattgataatgaaagcaaacattggccagaaggtgctgtgctgcattacatacattgctgttaagaaatactgtctcgggccagacgcagtggctcacgcctgtaatcccagcactttgggaggccgaggcgggcggatcacgaggtcaggagatcgagaccatcctggctaacacagtgaaatcccgtctctactaaaaatacaaaaaaattagctgggtgttgtggcaggtgcctgtagtcccagctactctggaggctgaggcaggagaatggcgtgaacccaggaggcggagtttgcagtgagctgagattgcgccacggtactccagcctgggcgacagagtgagactccatctcaaaaataaaaaaaaaaatactgtcttggcaggacaggcgcggtggctcacgcctgtaatcccagcactttgggaggccgaggtgggcaggtcaggagttcaagaccatcctggctaacacagtgaaaccccatctctactaaaaatacaaaaaatcagccgggcgtggtggtgggcgcctgtagtcccagctactcgggaggctggggcagaagaatggcgtgaacccgggaggcggagcttgcagtgggccaagatcactccactgcactccagcctgggtgacaagagcgagactccgtctcaaaaaaaaaaaaaaagaaatactgtctcggcacatctgcatacatttttaatgaaatgagtttccacatgaggagtttccccgtgaaatttctcctatggtgtaaccttatgaactttataatgtttacttgcactaaacatttcttggataaagttgtataaaatacagacattaagaagcagcatgcatttactgtcatcgtctgagctatccaggaagaaattcagatttttttaaaaaaaggttcttatctcttcccagagaccagatcaagataaatttaaaagatgaaagatatttcttttttttttttctttttttttttttgagatggattcttactaggtcaccaggctggagtgcagtggcgcgatctcagctcactgcaacctctgcctcctgggttcaagcaattctcctgcctcagcctcccgagtagttgggactacaggtgtgcgccaccacgcccagctaatttttgtatttttagtagagacggggtttcaccatgttggccaggatggtctcgatctcttgactttgtgatccgcccacctcggcctcccaaagtgctgggattacaggcatgagccaccatgctcggccttgaaagatatttctaatataaccaaggcctaaacatgtagagattaaagggaacacttaaggcattgactattgttttatttctttagcaaaatgagagcaaacaactgcttcctttttagaaagcactccccacatataacaacaatttgttctctctggagggcccggatctatgaccttactaacatccagcgatcccaaatccaagtgcctgtggtaccaggcagataaggtaaagaagtgaagcaggccaagtgagactgcagtggtctggtgctaccattcccatctggaggagcatctgattctaaaccccacccaatttgtgccatgcgggttgctggcccagtgtttccagaacttccagtttttcaagagatgttccatatcccagtttttaaatgtcagatcatattatgaatgctaggccagcgaaataaaacatctgtggagcaaagcaatccacatgttgccattttgtgaccttggccacagcttactcttgccatctattgcaatgtactggtttacattcccacttaaagtgtacatttcattgaacttgcctagggaatgtacctattaggttaaatatccattatctctgtgtgaggtttccttaaggggctaaccataaagctttattatgtgatacctcctttcctttggaacaattaaaaagagtgcaaagaaa

SEQ ID NO: 3260 - DNA, 6504 bp, Homo sapiens
gccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatcta

SEQ ID NO: 3261 - DNA, 4718 bp, Homo sapiens
agttgtaaagcaaacagtgtaggtattggaagccgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 3262 - DNA, 671 bp, Homo sapiens
ttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaa

SEQ ID NO: 3263 - DNA, 6855 bp, Homo sapiens
agccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagacacagtctccatcatcccagaacacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggcccgcaggaagagcagccacgcctggaccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttcta

SEQ ID NO: 3264 - DNA, 5042 bp, Homo sapiens
gttttcacttggtcggaatggggagagtgtgcaagagatcgctgcgggacaggttcctagagatcgctccgggacggtcgtgacggcccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaaaaaaa

SEQ ID NO: 3265 - DNA, 7078 bp, Homo sapiens
gcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtgcctgtatccagtggctttggtgggtgcagggagtcttgggcacagccagctcagctgtctgtggtatgagcaggaacaggtgccactcctgctcaggggaccctgccctacaccaggctgttccgtccccctggaggacatggggccaggtctggaggcattttgggttgtcacagctgggggctgttcctcggcttcagcgggtggaagcctcagatgctgttcaacatcttctggacacgggaggccccgacagagagaagcgtccacccgcaagtccacagtctgaggtctcccctcagagaccctgccctgcacacccacctccagccaaaggtcctgcctgccccagggctcaggggaaccttgccggtctgtggaacaggagaggggactctcgccagctgcaccaccctgcacgtagtaggtgtgcggtaaacatccaccagggaggctccagtcaaggctggcagatggggcggtccatccctagggcaggtgacagaagggaaaaggctgcctgctggcccccgagccaggtagcacatgcttgtgcctcagtttcccctcctgtaaagtgaggcgctggatccaggttctgtctactgggctctgcagcttggacgctcctaagaccaagcgacccaccctggggagggcagctatggctttggaatagctgtccaggcccgggtgcctccaagacggccaccacaccctgcctgtgctgcaggggtgcaggggtaaggggcaagactccagaggcctcctctctgcatctccttgtcttcagtggccggaggtgaggcctgagctcaggggaggggcttctgccacgaaccctatggcggggcacagcacacttttcccagggaggacccctgggccccctgcattatccccagcggagtgtggggtcaccttccaagagcgacattgagaagctccagctctaggagtgtgcagactcttaaccaggcaggcccaggccctggggcacacaaaggcggggcctgctctccccagctgcccctgccaatgggggctggactgtcctaccctcctcccttctacctccccactgtcttccctctccactgtcaccactgcctccctcttccactgtcctccatgcactgccctccctccaccttcccccacccccaccactccccatgctgtccccaggctccccccgctctcccccctccccactgtccccctccccatgctgtacccagctcaccccgctctcccctctccccactgtcccccctcccactccccatgctgtccccagctcaccctacatggacttggcgatgtccttccatggctcaccggtctgaatttccatgatgagccgggcctgcagctttgctcccctatccctgcccaggctgcagctgtccatgcagggagcgagctccagcacctgcggagtccttccgtgggggcctctccgtgccacagcagccagggacctcaggtgcctgtgcatgacaccaccgcccatcctcatcctgagccagcctctcaggatcaggacttggtttggcggcgttaaccttagagcctgcaaggggcttcctcctggtgggtctggccgtagcctggggaggccacagctccaggccactccagacctcccttcctctgggccttccatgtggtggcaaccaccgcagctgtaagggagggaaaatggagcgtttgttctcgggctgggctggggtctgggggaagccatgggcgtgaagactggagtattatttgatggagaagcggccactcctggagaccggcggcaaacacagaagcacagcgtggaaggtgctggtgtcagcccacacgggtgatggggtcagactcaggagtcacactcaggagtcaccaggctcaaagggcccaggcaccgcaagtcctgctcagccccagacacaatgcattcctgttgccctcgccctcagccaggccccacgcaggccagggagcactggcaaagcttggcaaccctctgggggccagccttcatccaggccgaaggtggtcagtggcccaccatggcccaggtagaaaactcacggattaagatttcatgcccgactccaaaggcaagagactttattattttattttttttgagccagagtatcgctctgtcacctaggctggagtgcaatctctgctcattgcaacatctgcctcccgaactcaagcaattctgcctcagcctcccaagtagctgggattacaggtgtgcgccaccatgcccaggtaattgtatttttagtagagacagggtttcaccatgttggtcaggctggtttcaaactcctgacctcaaatgatctgcccacctcgacctcccaaagtgctgggattacaggtgcgagccaccgcacctggctaccagacacttcagagttacaggttagtttttctttttcttttatttttttttttttggcggaggtgcagggggagttaaacaaacaaacaaaataaacaggccgggtgcggtggctcatgcctgtaatcccagcactttaggaggcctaggtgggtggatcacgagatcaggggttcaagaccagcctggccgagatggtaaaaccccgtctccactaaaaatacaaaaattggccaggcacggtggctcacacctgtaatcccagtactttgggaggctgaggtgggcagatcacctgaggtcaggagttcaagaccaacctgaccaacatggagaaaccccatctctactaaaaatacaaaattagccaggtgtggtggtgcatgcctgtaattccagctactcgggaggctgaggcaggagaattgcttgaacccaggaggcagaggttgcagtgggccaagatggcgccattgcactccagcctgggaacaagagcgaaactctgactaaaaaagaaagaaagaaagaaaaaaattagttgggcacggtggcaggcgcctgtaatcccaggtactcaggaggctgaggcaggagaattgcttgaacccgggaggcagaggtcgcagtgagccgagattgcaccactgccctccagcctgggtgacagagcaagactccgtctcaaaaaaaaaaaaaaaaaaaattggatacattgtaatacctcaaatacttgtaagtgaagcaccccagttcccatagagctgccgcactcagaggcttctgtaacctgcctgctcccagcattctatttagggtctggtatgtccagaatttgcagacacagcaattcctgcagcagcagtgcaccatgtggaaggggccccatgaccagcccactgtgagctcacacgtgatgactgaggcttcttcacacagcagggctctgggtgtgatacccagggcacacgcgtttgcacaggcacaggccacacaagttctcacatgctcagccccataagccgtgctggacaggcatggccatttacacccaggatcctgctgagaacagcaaccaactcaccaccctcgcatcatgatccttgccacacaggggctctggtggctttggtggcctgggctgtggctctgctgccagccaccttgagtgaagatccgggttctctgggtgctactcagctgctatgtggggagctggcccctggggtgatgagggcccttcccaacccgccctcagcccttggacagccaggatcacccggggctgtctgcatacagacttctcaggggagttctcagcttggacccttatctccccagaatcctggaacctgctccttctgctctcgtgactgactgtgttctctatgcaacttccaataaaacctcttcatttgaaaggaaaaaa

SEQ ID NO: 3266 - DNA, 1584 bp, Homo sapiens
gctgtcctcaccgcaatggcggctgtgagggtcctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttaga

SEQ ID NO: 3267 - DNA, 9621 bp, Homo sapiens
acagcgctcgcgctgctctcggcgctcgcagctgccgactggggatgacggcgggcaggaggagaccgcagccgaagggacacagacacgccgcttcaccagctcgcctcaggctgcccccctgcatttttgttttaatttttacggctttttcccctctctttcttcccttcctcctggtcccagcagagccaaggaaacccacaaaataagaaaggaagtgggccccggagcttggaacctccacagccggcttgtccagcgcagcgcgggggcgggaggctgcgcgcaccagttgccagcccggtgcgcggtacctttccttacttttcttgaaacagcgatcgtgcctgcatttggtggttttttggtttttgtttttttccttttcccgtatttgctgaatctccactatccgactttttttttttaatcttttctttccccccccccccaccccacctctttctggagcacgaatccaaacattttcccaagcaacaaagaaaagttcgcacgctggcaccgcagcccggacaggctggcgctgctgccgggcccccctccctccgacacttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacggtagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggctgtacagccatgctagcatcgagaaccacatccgcctggccgtggtgaaggtggtggtgctaggcgacaaggacaagagcctggaagtgagcaagaacgctgccaccacactcaagaacttttgcaagtggcagcaccaacacaaccagctgggagatgaccatgaggagcactacgatgcagctatcctgtttactcgggaggatttatgtgggcatcattcatgtgacaccctgggaatggcagacgttgggaccatatgttctccagagcgcagctgtgctgtgattgaagacgatggcctccacgcagccttcactgtggctcacgaaatcggacatttacttggcctctcccatgacgattccaaattctgtgaagagacctttggttccacagaagataagcgcttaatgtcttccatccttaccagcattgatgcatctaagccctggtccaaatgcacttcagccaccatcacagaattcctggatgatggccatggtaactgtttgctggacctaccacgaaagcagatcctgggccccgaagaactcccaggacagacctacgatgccacccagcagtgcaacctgacattcgggcctgagtactccgtgtgtcccggcatggatgtctgtgctcgcctgtggtgtgctgtggtacgccagggccagatggtctgtctgaccaagaagctgcctgcggtggaagggacgccttgtggaaaggggagaatctgcctgcagggcaaatgtgtggacaaaaccaagaaaaaatattattcaacgtcaagccatggcaactggggatcttggggatcctggggccagtgttctcgctcatgtggaggaggagtgcagtttgcctatcgtcactgtaataaccctgctcccagaaacaacggacgctactgcacagggaagagggccatctaccgctcctgcagtctcatgccctgcccacccaatggtaaatcatttcgtcatgaacagtgtgaggccaaaaatggctatcagtctgatgcaaaaggagtcaaaacttttgtggaatgggttcccaaatatgcaggtgtcctgccagcggatgtgtgcaagctgacctgcagagccaagggcactggctactatgtggtattttctccaaaggtgaccgatggcactgaatgtaggctgtacagtaattccgtctgcgtccgggggaagtgtgtgagaactggctgtgacggcatcattggctcaaagctgcagtatgacaagtgcggagtatgtggaggagacaactccagctgtacaaagattgttggaacctttaataagaaaagtaagggttacactgacgtggtgaggattcctgaaggggcaacccacataaaagttcgacagttcaaagccaaagaccagactagattcactgcctatttagccctgaaaaagaaaaacggtgagtaccttatcaatggaaagtacatgatctccacttcagagactatcattgacatcaatggaacagtcatgaactatagcggttggagccacagggatgacttcctgcatggcatgggctactctgccacgaaggaaattctaatagtgcagattcttgcaacagaccccactaaaccattagatgtccgttatagcttttttgttcccaagaagtccactccaaaagtaaactctgtcactagtcatggcagcaataaagtgggatcacacacttcgcagccgcagtgggtcacgggcccatggctcgcctgctctaggacctgtgacacaggttggcacaccagaacggtgcagtgccaggatggaaaccggaagttagcaaaaggatgtcctctctcccaaaggccttctgcgtttaagcaatgcttgttgaagaaatgttagcctgtggttatgatcttatgcacaaagataactggaggattcagcactgatgcagtcgtggtgaacaggaggtctacctaacgcacagaaagtcatgcttcagtgacattgtcaacaggagtccaattatgggcagaatctgctctctgtgaccaaaagaggatgtgcactgcttcacgtgacagtggtgaccttgcaatatagaaaaacttgggagttattgaacatcccctgggcttacaagaaacactgatgaatgtaaaatcaggggacatttgaagatggcagaactgtctcccccttgtcacctacctctgatagaatgtctttaatggtatcataatcattttcacccataatacacagtagcttcttcttactgtttgtaaatacattctcccttggtatgtcactttatatcccctggttctattaaaatatccatatatatttctataaaaaaagtgtttgaccaaagtaggtctgcagctatttcaacttccttccgtttccagaaagagctgtggatattttactggaaattaagaacttgctgctgttttaataagatgtagtatattttctgactacaggagataaaatttcagtcaaaaaaccattttgacagcaagtatcttctgagaaattttgaaaagtaaatagatctcagtgtatctagtcacttaaatacatacacgggttcatttacttaaacctttgactgcctgtatttttttcaggtagctagccaaattaatgcataatttcagatgtagaagtagggtttgcgtgtgtgtgtgtgatcatactcaagagtctaaaaactagtttccttgtgttggaaatttaaaaggaaaaaaatcgtatttcactgtgttttcaatttatattttcacaactactttctctctccagagctttcatctgatatctcacaatgtatgatatacgtacaaaacacacagcaagttttctatcatgtccaacacattcaacactggtatacctcctaccagcaagcctttaaaatgcatttgtgtttgcttatttgttttgttcaagggttcagtaagacctacaatgttttgtatttcttgacttattttattagaaacattaaagatcacttggtagttagccacattgagaagtggttatcattgttaatgtggttaatgccaaaaagtggttaatattaataagactgtttccacaccataggcaataatttcttaatttaaaaaatctaagtatattcctattgtactaaatatttttcccaactggaaagcacttgattgtacccgtaagtgtttgagtgatgacatgtgatgattttcagaaagttgttgtttttgtttccatagcctgtttaagtaggttgtaagtttgaatagttagacatggaaattattttataagcacacacctaaagatatctttttagatgataaaatgtacacccccccatcaccaacctcacaacttagaaaatctaagttgtttgatttctttgggatttcttttgttgtgaaacactgcaaagccaatttttctttataaaaattcatagtaatcctgccaaatgtgcctattgttaaagatttgcatgtgaagatcttagggaaccactgtttgagttctacaagctcatgagagtttatttttattataagatgtttttaatataaaagaattatgtaactgatcactatattacatcatttcagtgggccaggaaaatagatgtcttgctgttttcagtattttcttaagaaattgcttttaaaacaaataattgttttacaaaaccaataattatcctttgaattttcatagactgactttgcttttgacgtagaaattttttttctcaataaattatcactttgagaaatgaggcctgtacaaggctgataacctatatgtgatggagatcacccaatgccaagggcagaaagcaaacctagttaaataggtgagaaaaaaaataataatcccagtgccatttgtctgtgcaaagagaattaggagagaggttaatgttacttttttccattttggaaataattttaatcaagtaactcaaatgtgacaaaatttatttttattttttgtggttatattcccaacaacattaaaaaatactcgaggcataaatgtagttgtctcctactctgcttctcttactatactcatacatttttaatatggtttatcaatgattcatgtttccctcaaatagtgatggtttacacctgtcatggaaacaatcctagagagctcagagcaattaaaccactattccatgcttttaagtagttttctccacctttttcttatgagtctcactagattgactgaggaatgtatgtctaaattcctggagaagatgatatggattggaaactgaaattcagagaaatggagtgttcaatagataccacgaattgtgaacaaagggaaaattctatacaactcaatctaagtcagtccactttgacttcgtactgtctttcacctttccattgttgcatcttgaattttttaaaatgtctagaattcaggatgctaggggctacttctttaaaaaaaaaaaaaaaaaagaattcgtctgaaaatgctcaggtttgtaagaatctaatctcacttacataactaagcactccataataagttttattaagtacaaagggagccagaaaaaatgacatttatttcttctagatcagaaaaatttaaattaagccctgccttgctgtttagaaatatgtgggcattgttataatttattcaataaatttatgttcctttgccttcctgtggaaacagttttatcccactaaactaggaattaggggataaatcacaaacaaaaaaaaagttgcagcactgaaaaaaagtaatttattgtttttgcaactggtatgtgaatttgtgtgataaaattatttattcttatttaacaaaaatatgttcaaatttttctatatttaaaatgttttgctgttgtcctactttttaatttatgcttcatgtttgtgtataaagtacacttttacactttgtgagtttacataatatacagcactggttgcttttgtatttttttacagaaagctttctgtgtgaagcaggtgtatatgtatatattcctcatgtattcttattctgatactatcatttttctttccaaggaaattttaatctgtcatgaccaatagtgttcattacttgtgcctatgataataggttttttacatcacattaacactattttttccaagtcacaaataagaaaaacacttattcaatgaaacaaggtgcaagttttaaatttgggtacacaaatagcctagaagcttcctacagacgctaagacacagccaataatcagatcctttcacttcatcgagaaacttggacaagtcgatattgatgtattagatgaaagttgtctacacacaacttctgagggatacaaacgataataaaaccaaatgttgtctgtttctcctttagaaacacctcctaaaattaatatcatttagtctctagtgtctgtaggattctacagatgagcacaaatagattgggtttgtataacaaatgctaatagtcataactgtttctacaaatatggggtgtccattaagagaatgtgatgttttcctactgctgttgaatcccatggggtgattataggacttgaaataggcagagtcacctctgatgacatcagcttgcctctgtgatttcacagtctgatcctggcaacaagacaaagcacccttggacacacagccaatctctggttgtgatatttccccattgattccttccttgttaacaaggtcattttaatggttcaggtgaggacagcagccagattcaaagtccagaatttgtgctgttacatagagttcacactgtcaaataacattgaatttaataatgatcaaatttttctagtagtctttggcagagtgtataatctcattggcatgattggtgaatattactaatctctttataatgaaagatgctttacaaataccttatatttgctaacatttcaaaactactaaataaatgaaatagccatgtgtacagaaatggtcatttaaagctttaatagaaccaaattcaagacaatgtatcatttagacacacagaaaaggaacttgtatgttttccctattatttttctcatttgccaacaatctatagttttaggttatcaaacagatagatcaacttaactggctagtacattgaaaaatcttcctaagaatcctttgttagcataatctatagagataatttctcaaattatatcatcatgatgcatataaactctataatgtataattgtgtttcatttatttaatgtatgagaacatattgaaatacaaaaccatgcattagccaaaaaattggaatacaggtagtgttcagatcagcaaaacattcagtctggtaaatgcctgcctggggctatgatatcattctcaatgcaggttttatggaaaaactaaaagaatatgttgttagatgatgttggttttgaaaaaaaaaagacattaacatacacattagttagcccagttaattgcattctactaatatagttgcacattagcaataattttgctgtctctggtctttattttgtggcttcaactaactggaccatgtggactgtaaaggtcaaatggaaaaaacgagcagtggcccctcatcctgtaaggtactgctacatcagagtgacctaaaagtctaacactgtgaggaaaactgtgatttgtaggaaaaaaaaaaaaaacaaataaaaaacagggcatgctttttaatttttttccactttcctttggcacacccaatgaacaattctaatttttattgaggtgctaacatctttcgtgaccgactgtcaaatgtggtatttttgagttactatttttctacatgattttacagtttgcaagaaagacctctaagctttgtgtcacggtagggcacaacttgatactcaaaatttgaaaaataagcacatccaatgattgttttgaccaacagtggtcagtgacgtaaactgcatgtgcatctgaggacatttaaggggtcattaaaatttgaggagcatcaggccggagtagcagacttttagatgagtcatatttcagcattcactaagtcctcagcattccattcaaactgtcgtgtatatttggcctgattttttttcaagctttgcaataatttatgttattggtaaacacttggtgactatatctcagccttttctttaacaactcacaatatattagaaacacgtctacctatactgagagtatatttacaatagaagaacatactgtatgtgactttgtaaagctagacttttgattaagaaatatataatctctggatgctatttttgcattatacactcaggcacaacgtaaaccttgatggctcatcttgctacaattacgagttgaaaaacactacttacgtatttgtatgacctattagtcagaggaaatcatacatatgctttgtaaatagactttgcagataactaaatagactgaagaaatatgttgcatttgatagaagcaattgcataaatatttggtttctatattagagtctgtgagtaaagtcaagtaataaacctaagtaggtataacagatttttaaaccttgaaacttgctttgatggtagagaaaatcattgaagatttacatactgtatataagatgtaaaatgtacgctgcttattaccctcaattttccagaagcaatggtatataatgcagttgaaaaaccaaaaatcttggaaaactaagacgggtcttgtttaaaatgtctctcagctttggcaaccttcaaatcttaatcaactatttaaagcattactgtgtcttgtagcctgcattccacaacagctctgttattcaggtaaaagacttgaactgagccgtttgggacctatactgtaatattttcattgaggaacaatatcctattttgtaaagcatttccctatgtgtgactttaaactgtaaaattaaacactgcttttgtgggttcagtgggcataataaatataaattgtaaacta

SEQ ID NO: 3268 - DNA, 5593 bp, Homo sapiens
agtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaaggaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaaatattataaaaaataagtaaataaacagaacattaataataaagttttggttcttcctattcctgactttcatataatgaaaattatcctattgatctaagtagaagttatcatagaaagtggacacgtataagactttccttcctttttttttttaataacatatgaggaacaagacttctcttcccatatacttcatattttagaggacattgttttaaaggcttatgtctcactgtaaaattctgtcagccaaatagtaccaatacgttttcaagtagttctcactgataatttagttgaaccagagatcaaatatttgctcccgaattactactggtaatcaagtagttgaacaaaaaattactaaagcatttccgttagatcagtcaaggacagtactgcatctttttttttttttttttttttaagacggagtctcggtctgtcacccaggctggagtgcagtggcgggatctcggctcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtactttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactatccatatagatcatggatataaagagatacctgatttttattaaaaagatactttttcaaatttaagagttaatcttggaaatttggaacaagtaaaggggcaagtaaaccttttgatgaaatataaaaggaactcattgcatgaagttgactatcaaattctgtgatgtgtggcttcttaaaaatattctcagtgtcttttgtgtgcgtgcagcatgtacatttgatgttatgtgaatgttgagttttttcttctaattttcacttcagcagtgtttagggctttcagatgccttattccagtgtgaacagaaaaagttcatattttatgtggttaatgctttgatgtgtcacataaagagtagtttgtagaaaatgttggcacaattttaacttcttagtggcttgtgacattatatattatatatatatatgtacatatatctttataacattcctgtgtttagtagtgtaaatgttctgggcaagttttaatattttgaatgcctttggatattccagcaataaaggcatcatgttctgcaataggatttcttactcatttacctattttaacactaaaatagaccacaactgagcacaaattccttttataaatgttatagaagcagggaagaataataaacacatttgtgaattgtggttcagtttatttatctttagggaaggctgatcatttatcttatagcagataaccccagcctcttattcattatggttaacttttataatttatcttattttataatttaagaatatagtacatatcagttgggtttggttttggtcatcgagactaaaagctccatcaaaacagaactttgtgttttctgctaacttatttaatgacacaagttttaagagaaccacaattcattgattcacttattcttttccctaattgtgaattttagtgataaatacacctgtactactgaggaaaatattctgacacttcacgtgtgcaaagtatagaactgacagtgtcagtttcagattttgtatgtacgatttctggcttatatatccaatggtgcagattttgaaatttgtaagaacaaaatttgttaagaaaaacaacttgctctagttttgtgaccttgtgtacttttgaaataaaatcaagaaagcagt

SEQ ID NO: 3269 - DNA, 3401 bp, Homo sapiens
gcggggacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtcccctgacaagcccaccaggccccctgctgagatggctgtgaccctgggctgacccgcccagtggcacattgactccgcctggagctggggagaccagagaggccctgtggttggacggtggcctgggtgcgctgctcctgccctctccttgccctgcctcagctgctgcctgccagaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggaaactggctttgccaaggcccccgctgggacagactgtttctttcactgcagtcctgggagccgagggcaaggggacaggaaagaggaagtgacctcagagcctggtggcaccagcatcatgtccaggctggggggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagagcaca

SEQ ID NO: 3270 - DNA, 4991 bp, Homo sapiens
gctgtagtcccggagtccgcgtgcgcggggccgggtccgggagccccagggcagccgccccgccgagtcgcaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactccttttggagaattgtgtccttcctgtgacagtgaaggctgcttgcaaaccaagagtcagtgtaaaaggtcacttttatttgcctgtctgaattggcttcacatcacacacaattacagaaccagccccaccggtttcgtcgcagtcctgaggcaggtgcgtgttggctgtgctgtggtcagcctggcgctgccctgagtccacttgtccctccacagaacgaatgactcgggttgatgttgccggatctcaggggtggctgtgactgacagaggaccttgttgcacctcgtggctgctttgttcacccgcagggcggcctgtgggcaccccggggttccccttcagtcccaaggagggtaaggatatgggtttcctaggagacagccaatgactgccctgcatctggagccagcctgtccatgggcagtgcacagatgacagccctccctcactgccctgtgtgctggctaccgcatgtcctgtgccagcctcagcctctttgatgtggccgtgttccatcctggcgctcagctggacaagtgctggctgagccacgtcccagccaggggcatgagatgggggccctggatgggaggctgccagaccccaactcatgggtcccttgaatctcccagcttggactcggccagggtggagctgtctgctttggatgtatcatctcatggctcatttgggaggccagccccaggctgctgtgcttggtgttggaggacaggccggagctgggggtcacagtgcgcctctgagcttgggaacctgcttcagcctggggttgctgtggagaatggcccagagctgagcagaaggggctccccctagccccagggacctgagcctccctcccatctaccgcagggcgagcacacaccctggaggagcccagatggccttgtgctgagtgtggcctcagctcccattgcctcacggggcctgtctgctaacaggtctgggttttgtgcacagaacggtgctgctaggtgggagatgaagtcagcacctgctggggcgagcacggcttcccaaagcaggaaatcctggagaaatcgagccgtggtctgatcaggccaagaggttgcacagggcatgatactgcaccctgcctgacccagctgggctcacaggtcaggggagagttggggcaggtgaatgtcagcatcaggcttctgttttaaacttttaaaaaaataca

SEQ ID NO: 3271 - DNA, 7512 bp, Homo sapiens
ggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 3272 - DNA, 4203 bp, Homo sapiens
agaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 3273 - DNA, 2976 bp, Homo sapiens
ggagcccaagcgcagcccgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

The invention claimed is:

1. A method of detecting a combination of ribonucleic acid (RNA) biomarkers, the method comprising:

obtaining a plasma sample from a human subject, wherein the human subject is a pregnant female;

obtaining cell free nucleic acids from the plasma sample, wherein the cell free nucleic acids are cell free ribonucleic acids (RNA);

detecting in the cell free RNA the presence of the combination of RNA biomarkers, wherein the detecting comprises:

contacting the cell free RNA with a combination of primers or probes that are complementary to the combination of RNA biomarkers, and detecting hybridization between the primers or probes and the combination of RNA biomarkers, wherein the combination of RNA biomarkers used in the method consists of:

ATP5O, ICOSLG, DOP1B, PKNOX1, COL6A1, and GART.

2. A method of detecting a combination of ribonucleic acid (RNA) biomarkers, the method comprising:

obtaining a plasma sample from a human subject, wherein the human subject is a pregnant female;

obtaining cell free nucleic acids from the plasma sample, wherein the cell free nucleic acids are cell free ribonucleic acids (RNA);

detecting in the cell free RNA the presence of the combination of RNA biomarkers, wherein the detecting comprises:

contacting the cell free RNA with a combination of primers or probes that are complementary to the combination of RNA biomarkers, and detecting hybridization between the primers or probes and the combination of RNA biomarkers, wherein the combination of RNA biomarkers used in the method consists of:

RASGRP4, FAM20A, NEK9, ABCC1, SORBS2, TMPRSS2, DSCAM, ERG, ICOSLG, C21orf33, ADAMTS5, CXADR, NCAM2, UBASH3A, PFKL, CHODL, CYYR1, SLC19A1, PRDM15, COL6A1, and ABCG1.

3. The method of claim 1, further comprising detecting a normalization nucleic acid.

4. The method of claim 1, further comprising:

obtaining a plasma sample from a second human subject, wherein the second human subject is a pregnant female carrying a fetus without trisomy 21;

obtaining a second cell free ribonucleic acid sample from the plasma sample; and detecting in the second cell free ribonucleic acid sample the presence of the combination of RNA biomarkers.

5. The method of claim 4, further comprising:

quantitating the amount of each RNA biomarker in the cell free RNA from the pregnant female; and quantitating the amount of each RNA biomarker in the second cell free ribonucleic acid sample from the second pregnant female.

6. A method of detecting a combination of ribonucleic acid (RNA) biomarkers, the method comprising:

obtaining a plasma sample from a human subject, wherein the human subject is a pregnant female;

obtaining cell free nucleic acids from the plasma sample, wherein the cell free nucleic acids are cell free ribonucleic acids (RNA);

detecting in the cell free RNA the presence of the combination of RNA biomarkers, wherein the detecting comprises:

contacting the cell free RNA with a combination of primers or probes that are complementary to the combination of RNA biomarkers, and detecting hybridization between the primers or probes and the combination of RNA biomarkers, wherein the combination of RNA biomarkers used in the method consists of:

ATP5O, ICOSLG, DOP1B, PKNOX1, COL6A1, GART, RASGRP4, FAM20A, NEK9, ABCC1, SORBS2, TMPRSS2, DSCAM, ERG, ICOSLG, C21orf33, ADAMTS5, CXADR, NCAM2, UBASH3A, PFKL, CHODL, CYYR1, SLC19A1, PRDM15, COL6A1, and ABCG1.

7. The method of claim 6, further comprising detecting a normalization nucleic acid.

8. The method of claim 6, further comprising:

obtaining a plasma sample from a second human subject, wherein the second human subject is a pregnant female carrying a fetus without trisomy 21;

obtaining a second cell free ribonucleic acid sample from the plasma sample; and detecting in the second cell free ribonucleic acid sample the presence of the combination of RNA biomarkers.

9. The method of claim 8, further comprising:

quantitating the amount of each RNA biomarker in the cell free RNA from the pregnant female; and quantitating the amount of each RNA biomarker in the second cell free ribonucleic acid sample from the second pregnant female.

10. The method of claim 2, further comprising detecting a normalization nucleic acid.

11. The method of claim 2, further comprising:

obtaining a plasma sample from a second human subject, wherein the second human subject is a pregnant female carrying a fetus without trisomy 21;

obtaining a second cell free ribonucleic acid sample from the plasma sample; and detecting in the second cell free ribonucleic acid sample the presence of the combination of RNA biomarkers.

12. The method of claim 11, further comprising:

quantitating the amount of each RNA biomarker in the cell free RNA from the pregnant female; and quantitating the amount of each RNA biomarker in the second cell free ribonucleic acid sample from the second pregnant female.

* * * * *